US007368261B1

(12) United States Patent
Rappuoli

(10) Patent No.: US 7,368,261 B1
(45) Date of Patent: May 6, 2008

(54) CONSERVED *NEISSERIAL* ANTIGENS

(75) Inventor: Rino Rappuoli, Siene (IT)

(73) Assignee: Novartis Vaccines and Diagnostics SRL, Siena (IT)

( * ) Notice: Subject to any disclaimer, the term of this patent is extended or adjusted under 35 U.S.C. 154(b) by 0 days.

(21) Appl. No.: 09/980,602

(22) PCT Filed: Apr. 28, 2000

(86) PCT No.: PCT/IB00/00642

§ 371 (c)(1),
(2), (4) Date: Sep. 20, 2002

(87) PCT Pub. No.: WO00/66741

PCT Pub. Date: Nov. 9, 2000

(30) Foreign Application Priority Data

Apr. 30, 1999 (GB) .................. 9910168.5
Mar. 9, 2000 (GB) .................. 0005728.1

(51) Int. Cl.
C12P 21/06 (2006.01)
C12P 21/04 (2006.01)
C12N 15/09 (2006.01)
C07H 21/04 (2006.01)
A61K 39/095 (2006.01)

(52) U.S. Cl. .................. 435/69.1; 435/69.3; 435/71.1; 536/23.7; 424/185.1; 424/190.1; 424/234.1; 424/250.1

(58) Field of Classification Search ............. 424/250.1, 424/190.1, 185.1, 234, 234.1; 435/69.3, 435/69.1, 71.1; 536/23.7
See application file for complete search history.

(56) References Cited

U.S. PATENT DOCUMENTS 6,197,312 B1 * 3/2001 Peak et al. ................ 424/250.1
2002/0160016 A1 * 10/2002 Peak et al. ................ 424/190.1

FOREIGN PATENT DOCUMENTS

| EP | 0 273 116 A2 | 7/1988 |
| WO | WO96/29412 A1 | 9/1996 |
| WO | WO99/24578 A2 | 5/1999 |
| WO | WO99/36544 A2 | 7/1999 |
| WO | WO99/57280 A2 | 11/1999 |
| WO | WO00/22430 A2 | 4/2000 |

OTHER PUBLICATIONS

Infect Immun. Aug. 1996; 64(8):2998-3006.*
Ala'Aldeen et al., "The meningococcal transferrin-binding proteins 1 and 2 are both surface exposed and generate bactericidal antibodies capable of killing homologous and heterologous strains," *Vaccine* 14(1):49-53, 1996.

Bygraves et al., "Analysis of the clonal relationships between strains of Neisseria meningitidis by pulsed field gel electrophoresis," *J. Gen. Microbiol.* 138:523-531, 1992.

Caugant et al., "Genetic structure of Neisseria meningitidis populations in relation to serogroup, serotype, and outer membrane protein pattern," *J. Bacteriol.* 69:2781-2792, 1987.

Cooney et al., "Three contiguous lipoprotein genes in Pasteurella haemolytica A1 which are homologous to a lipoprotein gene in Haemophilus influenzae type b," *Infection and Immunity* 61(11):4682-4688, 1993.

Dempsey et al., "Physical map of the chromosome of Neisseria gonorrhoeae FA1090 with locations of genetic markers, including opa and pil genes," *J. Bacteriol.* 173:5476-5486, 1991.

Gervais et al., "Putative lipoprotein yaec precursor," *Database Swissport Acc No* :p28635, 1992.

Maiden et al., "Multilocus sequence typing: a portable approach to the identification of clones within populations of pathogenic microorganisms," *Proc. Natl. Acad. Sci. USA* 95:3140-3145, 1998.

Ni et al., "Phylogenetic and epidemiological analysis of Neisseria meningitidis using DNA probes," *Epidemiol. Infect.* 109:227-239, 1992.

Pettersson et al., "Sequence variability of the meningococcal lactoferrin-binding protein LbpB," *Gene* 231:105-110, 1999.

Poolman, "Development of a meningococcal vaccine," *Infect. Agents Dis.* 4:13-28, 1995.

Seiler et al., "Allelic polymorphism and site-specific recombination in the opc locus of Neisseria meningitidis," *Mol. Microbiol.* 19(4):841-856, 1996.

Tettelin et al., "Complete genome sequence of Neisseria meningitidis serogroup B strain MC58," *Science* 287:1809-1815, 2000.

Thompson et al., "Clustal W: improving the sensitivity of progressive multiple sequence alignment through sequence wighting, position-specific gap penalities and weight matrix choice," *Nucleic Acids Res.* 22:4673-4680, 1994.

Thompson et al., "Multiple sequence alignment with clustal X," *Trends Biochem. Sci.* 23:403-405, 1998.

Virji et al., "Variations in the expression of pili: the effect on adherence of Neisseria meningitidis to human epithelial and endothelial cells," *Mol. Microbiol.* 6:1271-1279, 1992.

Wolff et al., "Phylogeny and nucleotide sequence of a 23S rRNA gene from Neisseria gonorrhoeae and Neisseria meningitidis," *Nucleic Acids Res.* 20:4657, 1992.

* cited by examiner

*Primary Examiner*—Susan Ungar
*Assistant Examiner*—Padma Baskar
(74) *Attorney, Agent, or Firm*—Otis B. Littlefield; Amy L. Hessler; Alisa A. Harbin

(57) ABSTRACT

To ensure maximum cross-strain recognition and reactivity, regions of proteins that are conserved between different Neisserial species, serogroups and strains can be used. The invention provides proteins which comprise stretches of amino acid sequence that are shared across the majority of Neisseria, particularly *N. meningitidis* and *N. gonorrhoeae*.

2 Claims, 97 Drawing Sheets

| | | | | |
|---|---|---|---|---|
| zn07_1 | 289 | VTGKD KGENGSST DEGEGLVTAKEVIDAVNKAGWRMKTTTANGQTGQADKFETVTSGTNV |
| zn20_1 | 289 | VTGKD KGENGSST DEGEGLVTAKEVIDAVNKAGWRMKTTTANGQTGQADKFETVTSGTNV |
| zn21_1 | 289 | VTGKD KGENGSST DEGEGLVTAKEVIDAVNKAGWRMKTTTANGQTGQADKFETVTSGTNV |
| zn06_1 | 289 | VTGKD KGENGSST DEGEGLVTAKEVIDAVNKAGWRMKTTTANGQTGQADKFETVTSGTNV |
| zn19_1 | 289 | VTGKD KGENGSST DEGEGLVTAKEVIDAVNKAGWRMKTTTANGQTGQADKFETVTSGTNV |
| zn03_1 | 291 | VTGKD KGENGSST DEGEGLVTAKEVIDAVNKAGWRMKTTTANGQTGQADKFETVTSGTKV |
| zn18_1 | 291 | VTGKD KGENGSST DEGEGLVTAKEVIDAVNKAGWRMKTTTANGQTGQADKFETVTSGTNV |
| zn11_ass | 291 | VTGKG KGENGSST DEGEGLVTAKEVIDAVNKAGWRMKTTTANGQTGQADKFETVTSGTNV |
| zn02_1 | 291 | VTGKG KDENGSST DEGEGLVTAKEVIDAVNKAGWRMKTTTANGQTGQADKFETVTSGTNV |
| zn04_1 | 291 | VTGKG KDENGSST DEGEGLVTAKEVIDAVNKAGWRMKTTTANGQTGQADKFETVTSGTKV |
| zn16_1 | 295 | VTGKG KGENGSST DEGEGLVTAKEVIDAVNKAGWRMKTTTANGQTGQADKFETVTSGTKV |
| zn14_1 | 296 | VTGKG KGENGSST DEGEGLVTAKEVIDAVNKAGWRMKTTTANGQTGQADKFETVTSGTNV |
| z2491 | 289 | VTGKG KGENGSST DEGEGLVTAKEVIDAVNKAGWRMKTTTANGQTGQADKFETVTSGTNV |
| zn10_1 | 289 | VTGKG KGENGSST DEGEGLVTAKEVIDAVNKAGWRMKTTTANGQTGQADKFETVTSGTNV |
| zn22_1 | 289 | VTGKG KGENGSST DEGEGLVTAKEVIDAVNKAGWRMKTTTANGQTGQADKFETVTSGTNV |
| zn23_1 | 289 | VTGKG KGENGSST DEGEGLVTAKEVIDAVNKAGWRMKTTTANGQTGQADKFETVTSGTNV |
| zn28_ass | 286 | VTGKG KGENGSST DEGEGLVTAKEVIDAVNKAGWRMKTTTANGQTGQADKFETVTSGTNV |
| zn24_1 | 289 | VTGKG KGENGSST DEGEGLVTAKEVIDAVNKAGWRMKTTTANGQTGQADKFETVTSGTNV |
| zn25_ass | 286 | VTGKG KGENGSST DEGEGLVTAKEVIDAVNKAGWRMKTTTANGQTGQADKFETVTSGTKV |
| zn08_1 | 292 | VTGKG KGENGSST DEGEGLVTAKEVIDAVNKAGWRMKTTTANGQTGQADKFETVTSGTNV |
| zn29_ass | 297 | VTGKG KGENGSST DEGEGLVTAKEVIDAVNKAGWRMKTTTANGQTGQADKFETVTSGTKV |

FIG. 1C

| | | | | | |
|---|---|---|---|---|---|
| zn07_1_1 | 349 | TFASGK | GTTATVSKDDQGNITVM | YDVNVGDALNVNQLQNSGWNLDSKAVAGSSGKVISGN |
| zn20_1_1 | 349 | TFASGK | GTTATVSKDDQGNITVM | YDVNVGDALNVNQLQNSGWNLDSKAVAGSSGKVISGN |
| zn21_1_1 | 349 | TFASGK | GTTATVSKDDQGNITVM | YDVNVGDALNVNQLQNSGWNLDSKAVAGSSGKVISGN |
| zn06_1_1 | 349 | TFASGK | GTTATVSKDDQGNITVM | YDVNVGDALNVNQLQNSGWNLDSKAVAGSSGKVISGN |
| zn19_1_1 | 349 | TFASGK | GTTATVSKDDQGNITVM | YDVNVGDALNVNQLQNSGWDLDSKAVAGSSGKVISGN |
| zn03_1_1 | 349 | TFASGN | GTTATVSKDDQGNITVM | YDVNVGDALNVNQLQNSGWNLDSKAVAGSSGKVISGN |
| zn18_1_1 | 351 | TFASGN | GTTATVSKDDQGNITVM | YDVNVGDALNVNQLQNSGWNLDSKAVAGSSGKVISGN |
| zn11_1_ass | 351 | TFASGN | GTTATVSKDDQGNITVM | YDVNVGDALNVNHLQNSGWNLDSKAVAGSSGKVISGN |
| zn02_1_1 | 351 | TFASGN | GTTATVSKDDQGNITVM | YDVNVGDALNVNQLQNSGWNLDSKAVAGSSGKVISGN |
| zn04_1_1 | 351 | TFASGN | GTTATVSKDDQGNITVM | YDVNVGDALNVNQLQNSGWNLDSKAVAGSSGKVISGN |
| zn16_1_1 | 355 | TFASGN | GTTATVSKDDQGNITVM | YDVNVGDALNVNQLQNSGWNLDSKAVAGSSGKVISGN |
| zn14_1_1 | 356 | TFASGN | GTTATVSKDDQGNITVK | YDVNVGDALNVNQLQNSGWNLDSKAVAGSSGKVISGN |
| z2491_1_1 | 349 | TFASGK | GTTATVSKDDQGNITVK | YDVNVGDALNVNQLQNSGWNLDSKAVAGSSGKVISGN |
| zn10_1_1 | 349 | TFASGK | GTTATVSKDDQGNITVK | YDVNVGDALNVNQLQNSGWNLDSKAVAGSSGKVISGN |
| zn22_1_1 | 349 | TFASGK | GTTATVSKDDQGNITVK | YDVNVGDALNVNQLQNSGWNLDSKAVAGSSGKVISGN |
| zn23_1_1 | 349 | TFASGK | GTTATVSKDDQGNITVK | YDVNVGDALNVNQLQNSGWNLDSKAVAGSSGKVISGN |
| zn28_1_ass | 346 | TFASGK | GTTATVSKDDQGNITVM | YDVNVGDALNVNQLQNSGWNLDSKAVAGSSGKVISGN |
| zn24_1_1 | 346 | TFASGN | GTTATVSKDDQGNITVM | YDVNVGDALNVNQLQNSGWNLDSKAVAGSSGKVISGN |
| zn25_1_ass | 346 | TFASGN | GTTATVSKDDQGNITVM | YDVNVGDALNVNQLQNSGWNLDSKAVAGSSGKVISGN |
| zn08_1_1 | 352 | TFASGN | GTTATVSKDDQGNITVK | YDVNVGDALNVNQLQNSGWNLDSKAVAGSSGKVISGN |
| zn29_1_ass | 357 | TFASGN | GTTATVSKDDQGNITVK | YDVNVGDALNVNQLQNSGWNLDSKAVAGSSGKVISGN |

| | | |
|---|---|---|
| zn07_1 | 588 | GYQW* |
| zn20_1 | 588 | GYQW* |
| zn21_1 | 588 | GYQW* |
| zn06_1 | 588 | GYQW* |
| zn19_1 | 588 | GYQW* |
| zn03_1 | 591 | GYQW* |
| zn18_1 | 591 | GYQW* |
| zn11_ass | 591 | GYQW* |
| zn02_1 | 591 | GYQW* |
| zn04_1 | 591 | GYQW* |
| zn16_1 | 595 | GYQW* |
| zn14_1 | 596 | GYQW* |
| zn2491 | 589 | GYQW* |
| zn10_1 | 589 | GYQW* |
| zn22_1 | 589 | GYQW* |
| zn23_1 | 589 | GYQW* |
| zn28_ass | 589 | GYQW* |
| zn24_1 | 586 | GYQW* |
| zn25_ass | 586 | GYQW* |
| zn08_1 | 592 | GYQW* |
| zn29_ass | 597 | GYQW* |

```
zv11_4    60  EQIQVELEKKGYTVKLVEFTDYVRPNLALAEGELDINVFQHKPYLDDFKKEHN
zv29_4    60  EQIQVELEKKGYTVKLVEFTDYVRPNLALAEGELDINVFQHKPYLDDFKKEHN
zv22_4    60  EQIQPELEKKGYTVKLVEFTDYVRPNLALAEGELDINVFQHKPYLDDFKKEHN
zv12_4ass 60  EQIQAELEKKGYTVKLVEFTDYVRPNLALGEGELDINVFQHKPYLDDFKKEHN
zv24_4ass 60  EHIQPELEKKGYTVELVEFTDDVRPNLALGEGELDIIVFQHKPYLDDFKKEQN
```

FIG. 2B (CONTD.)

| | | |
|---|---|---|
| fa1090_4 | 121 | QVPTAPLGLYPGKLKSLEEVKDGSTVSAPNDPSNFARALVMNELGWIKLKDG |
| zv32_4 | 121 | QVPTAPLGLYPGKLKSLEEVKDGSTVSAPNDPSNFARALVMNELGWIKLKDG |
| zv33_4 | 121 | QVPTAPLGLYPGKLKSLEEVKDGSTVSAPNDPSNFARALVMNELGWIKLKDG |
| zv02_4 | 120 | QVPTAPLGLYPGKLKSLEEVKDGSTVSAPNDPSNFARALVMLDELGWIKLKDG |
| zv15_4 | 120 | QVPTAPLGLYPGKLKSLEEVKDGSTVSAPNDPSNFARVLVMLDELGWIKLKDG |
| zv03_4ass | 120 | QVPTAPLGLYPGKLKSLEEVKDGSTVSAPNDPSNFARVLVMLDELGWIKLKDG |
| zv04_4 | 120 | QVPTAPLGLYPGKLKSLEEVKDGSTVSAPNDPSNFARVLVMLDELGWIKLKDG |
| zv05_4 | 120 | QVPTAPLGLYPGKLKSLEEVKDGSTVSAPNDPSNFARVLVMLDELGWIKLKDG |
| zv09_4 | 120 | QVPTAPLGLYPGKLKSLEEVKDGSTVSAPNDPSNFARVLVMLDELGWIKLKDG |
| zv16_4 | 120 | QVPTAPLGLYPGKLKSLEEVKDGSTVSAPNDPSNFARVLVMLDELGWIKLKDG |
| zv18_4 | 120 | QVPTAPLGLYPGKLKSLEEVKDGSTVSAPNDPSNFARVLVMLDELGWIKLKDG |
| zv26_4 | 120 | QVPTAPLGLYPGKLKSLEEVKDGSTVSAPNDPSNFARVLVMLDELGWIKLKDG |
| zv28_4 | 120 | QVPTAPLGLYPGKLKSLEEVKDGSTVSAPNDPSNFARVLVMLDELGWIKLKDG |
| zv08_4 | 120 | QVPTAPLGLYPGKLKSLEEVKDGSTVSAPNDPSNFARVLVMLDELGWIKLKDG |
| zv10_4 | 120 | QVPTAPLGLYPGKLKSLEEVKDGSTVSAPNDPSNFARVLVMLDELGWIKLKDG |
| zv25_4 | 120 | QVPTAPLGLYPGKLKSLEEVKDGSTVSAPNDPSNFARALVMLDELGWIKLKDG |
| zv17_4 | 120 | QVPTAPLGLYPGKLKSLEEVKDGSTVSAPNDPSNFARVLVMLDELGWIKLKDG |
| z2491_4 | 120 | QVPTAPLGLYPGKLKSLEEVKDGSTVSAPNDPSNFARVLVMLDELGWIKLKDG |
| zv96_4 | 120 | QVPTAPLGLYPGKLKSLEEVKDGSTVSAPNDPSNFARVLVMLDELGWIKLKDG |
| zv06_4 | 120 | QVPTAPLGLYPGKLKSLEEVKDGSTVSAPNDPSNFARVLVMLDELGWIKLKDG |
| zv19_4 | 120 | QVPTAPLGLYPGKLKSLEEVKDGSTVSAPNDPSNFARVLVMLDELGWIKLKDG |
| zv20_4 | 120 | QVPTAPLGLYPGKLKSLEEVKDGSTVSAPNDPSNFARVLVMLDELGWIKLKDG |
| zv13_4 | 120 | QVPTAPLGLYPGKLKSLEEVKDGSTVSAPNDPSNFARVLVMLDELGWIKLKDG |
| zv27_4 | 120 | QVPTAPLGLYPGKLKSLEEVKDGSTVSAPNDPSNFARVLVMLDELGWIKLKDG |
| zv01_4 | 120 | QVPTAPLGLYPGKLKSLEEVKDGSTVSAPNDPSNFARVLVMLDELGWIKLKDG |
| zv07_4 | 120 | QVPTAPLGLYPGKLKSLEEVKDGSTVSAPNDPSNFARVLVMLDELGWIKLKDG |
| zv21_4 | 120 | QVPTAPLGLYPGKLKSLEEVKDGSTVSAPNDPSNFARVLVMLDELGWIKLKDG |
| zv11_4 | 120 | QVPTAPLGLYPGKLKSLEEVKDGSTVSAPNDPSNFARVLVMLDELGWIKLKDG |
| zv29_4 | 120 | QVPTAPLGLYPGKLKSLEEVKDGSTVSAPNDPSNFARVLVMLDELGWIKLKDG |
| zv22_4 | 120 | QVPTAPLGLYPGKLKSLEEVKDGSTVSAPNDPSNFARVLVMLDELGWIKLKDG |
| zv12_4ass | 120 | QVPTAPLGLYPGKLKSLEEVKDGSTVSAPNDPSNFARVLVMLDELGWIKLKDG |
| zv24_4ass | 120 | QVPTAPLGLYPGKLKSLEEVKDGSTVSAPNDPSNFARVLVMLDELGWIKLKDG |

FIG. 2B (CONTD)

| | | |
|---|---|---|
| fa1090_4 | 181 | KADIAENLKNIKIVELEAAQLPRSRADVDFAVVNGNYAISSGMKLTEALFQEP |
| zv32_4 | 181 | KADIAENLKNIKIVELEAAQLPRSRADVDFAVVNGNYAISSGMKLTEALFQEP |
| zv33_4 | 181 | KADIAENLKNIKIVELEAAQLPRSRADVDFAVVNGNYAISSGMKLTEALFQEP |
| zv02_4 | 180 | KADIAENLKNIKIVELEAAQLPRSRADVDFAVVNGNYAISSGMKLTEALFQEP |
| zv15_4 | 180 | KADIAENLKNIKIVELEAAQLPRSRADVDFAVVNGNYAISSGMKLTEALFQEP |
| zv03_4ass | 180 | KADIAENLKNIKIVELEAAQLPRSRADVDFAVVNGNYAISSGMKLTEALFQEP |
| zv04_4 | 180 | KADIAENLKNIKIVELEAAQLPRSRADVDFAVVNGNYAISSGMKLTEALFQEP |
| zv05_4 | 180 | KADIAENLKNIKIVELEAAQLPRSRADVDFAVVNGNYAISSGMKLTEALFQEP |
| zv09_4 | 180 | KADIAENLKNIKIVELEAAQLPRSRADVDFAVVNGNYAISSGMKLTEALFQEP |
| zv16_4 | 180 | KADIAENLKNIKIVELEAAQLPRSRADVDFAVVNGNYAISSGMKLTEALFQEP |
| zv18_4 | 180 | KADIAENLKNIKIVELEAAQLPRSRADVDFAVVNGNYAISSGMKLTEALFQEP |
| zv26_4 | 180 | KADIAENLKNIKIVELEAAQLPRSRADVDFAVVNGNYAISSGMKLTEALFQEP |
| zv28_4 | 180 | KADIAENLKNIKIVELEAAQLPRSRADVDFAVVNGNYAISSGMKLTEALFQEP |
| zv08_4 | 180 | KADIAENLKNIKIVELEAAQLPRSRADVDFAVVNGNYAISSGMKLTEALFQEP |
| zv10_4 | 180 | KADIAENLKNIKIVELEAAQLPRSRADVDFAVVNGNYAISSGMKLTEALFQEP |
| zv25_4 | 180 | KADIAENLKNIKIVELEAAQLPRSRADVDFAVVNGNYAISSGMKLTEALFQEP |
| zv17_4 | 180 | KADIAENLKNIKIVELEAAQLPRSRADVDFAVVNGNYAISSGMKLTEALFQEP |
| zv96_4 | 180 | KADIAENLKNIKIVELEAAQLPRSRADVDFAVVNGNYAISSGMKLTEALFQEP |
| zv06_4 | 180 | KADIAENLKNIKIVELEAAQLPRSRADVDFAVVNGNYAISSGMKLTEALFQEP |
| zv19_4 | 180 | KADIAENLKNIKIVELEAAQLPRSRADVDFAVVNGNYAISSGMKLTEALFQEP |
| zv20_4 | 180 | KADIAENLKNIKIVELEAAQLPRSRADVDFAVVNGNYAISSGMKLTEALFQEP |
| z2491_4 | 180 | KADIAENLKNIKIVELEAAQLPRSRADVDFAVVNGNYAISSGMKLTEALFQEP |

FIG.2C

| | | |
|---|---|---|
| zv13_4 | 180 | KADIAENLKNIKIVELEAAQLPRSRADVDFAVVNGNYAISSGMKLTEALFQEP |
| zv27_4 | 180 | KADIAENLKNIKIVELEAAQLPRSRADVDFAVVNGNYAISSGMKLTEALFQEP |
| zv01_4 | 180 | KADIAENLKNIKIVELEAAQLPRSRADVDFAVVNGNYAISSGMKLTEALFQEP |
| zv07_4 | 180 | KADIAENLKNIKIVELEAAQLPRSRADVDFAVVNGNYAISSGMKLTEALFQEP |
| zv21_4 | 180 | KADIAENLKNIKIVELEAAQLPRSRADVDFAVVNGNYAISSGMKLTEALFQEP |
| zv11_4 | 180 | KADIAENLKNIKIVELEAAQLPRSRADVDFAVVNGNYAISSGMKLTEALFQEP |
| zv29_4 | 180 | KADIAENLKNIKIVELEAAQLPRSRADVDFAVVNGNYAISSGMKLTEALFQEP |
| zv22_4 | 180 | KADIAENLKNIKIVELEAAQLPRSRADVDFAVVNGNYAISSGMKLTEALFQEP |
| zv12_4ass | 180 | KADIAENLKNIKIVELEAAQLPRSRADVDFAVVNGNYAISSGMKLTEALFQEP |
| zv24_4ass | 180 | KADIAENLKNIKIVELEAAQLPRSRADVDFAVVNGNYAISSGMKLTEALFQEP |

| | | | |
|---|---|---|---|
| zo005 | 225 | 152 | MQBIFKRAMGINLPRTSAEQARMGTPVARSELQPGDMVFFRTLGGSRISHVGLYIGNNRF |
| zo008 | 225 | 152 | MQBIFKRAMGINLPRTSAEQARMGTPVARSELQPGDMVFFRTLGGSRISHVGLYIGNNRF |
| z2491 | | 181 | MQBIFKRAMGINLPRTSAEQARMGTPVARSELQPGDMVFFRTLGGSRISHVGLYIGNNRF |
| zo011 | 225 | 181 | MQBIFKRAMGINLPRTSAEQARMGTPVARSELQPGDMVFFRTLGGSRISHVGLYIGNNRF |
| zo020 | 225 | 181 | MQBIFKRAMGINLPRTSAEQARMGTPVARSELQPGDMVFFRTLGGSRISHVGLYIGNNRF |
| zo001 | 225 | 152 | MQBIFKRAMGINLPRTSAEQARMGTPVARSELQPGDMVFFRTLGGSRISHVGLYIGNNRF |
| zo009 | 225 | 152 | MQBIFKRAMGINLPRTSAEQARMGTPVARSELQPGDMVFFRTLGGSRISHVGLYIGNNRF |
| zo012 | 225 | 152 | MQBIFKRAMGINLPRTSAEQARMGTPVARSELQPGDMVFFRTLGGSRISHVGLYIGNNRF |
| zo022 | 225 | 152 | MQBIFKRAMGINLPRTSAEQARMGTPVARSELQPGDMVFFRTLGGSRISHVGLYIGNNRF |
| zo023 | 225 | 152 | MQBIFKRAMGINLPRTSAEQARMGTPVARSELQPGDMVFFRTLGGSRISHVGLYIGNNRF |
| zo024 | 225 | 152 | MQBIFKRAMGINLPRTSAEQARMGTPVARSELQPGDMVFFRTLGGSRISHVGLYIGNNRF |
| zo025 | 225 | 152 | MQBIFKRAMGINLPRTSAEQARMGTPVARSELQPGDMVFFRTLGGSRISHVGLYIGNNRF |
| zo026 | 225 | 152 | MQBIFKRAMGINLPRTSAEQARMGTPVARSELQPGDMVFFRTLGGSRISHVGLYIGNNRF |
| zo096 | 225 | 152 | MQBIFKRAMGINLPRTSAEQARMGTPVARSELQPGDMVFFRTLGGSRISHVGLYIGNNRF |
| zo002 | 225 | 152 | MQBIFKRAMGINLPRTSAEQARMGTPVARSELQPGDMVFFRTLGGSRISHVGLYIGNNRF |
| zo004 | 225 | 152 | MQBIFKRAMGINLPRTSAEQARMGTPVARSELQPGDMVFFRTLGGSRISHVGLYIGNNRF |
| zo006 | 225 | 152 | MQBIFKRAMGINLPRTSAEQARMGTPVARSELQPGDMVFFRTLGGSRISHVGLYIGNNRF |
| zo007 | 225 | 152 | MQBIFKRAMGINLPRTSAEQARMGTPVARSELQPGDMVFFRTLGGSRISHVGLYIGNNRF |
| zo010 | 225 | 152 | MQBIFKRAMGINLPRTSAEQARMGTPVARSELQPGDMVFFRTLGGSRISHVGLYIGNNRF |
| zo014 | 225 | 152 | MQBIFKRAMGINLPRTSAEQARMGTPVARSELQPGDMVFFRTLGGSRISHVGLYIGNNRF |
| zo016 | 225 | 152 | MQBIFKRAMGINLPRTSAEQARMGTPVARSELQPGDMVFFRTLGGSRISHVGLYIGNNRF |
| zo017 | 225 | 152 | MQBIFKRAMGINLPRTSAEQARMGTPVARSELQPGDMVFFRTLGGSRISHVGLYIGNNRF |
| zo018 | 225 | 152 | MQBIFKRAMGINLPRTSAEQARMGTPVARSELQPGDMVFFRTLGGSRISHVGLYIGNNRF |
| zo019 | 225 | 152 | MQBIFKRAMGINLPRTSAEQARMGTPVARSELQPGDMVFFRTLGGSRISHVGLYIGNNRF |
| zo021 | 225 | 152 | MQBIFKRAMGINLPRTSAEQARMGTPVARSELQPGDMVFFRTLGGSRISHVGLYIGNNRF |
| zo027 | 225 | 152 | MQBIFKRAMGINLPRTSAEQARMGTPVARSELQPGDMVFFRTLGGSRISHVGLYIGNNRF |
| zo028 | 225 | 152 | MQBIFKRAMGINLPRTSAEQARMGTPVARSELQPGDMVFFRTLGGSRISHVGLYIGNNRF |
| zo029 | 225 | 152 | MQBIFKRAMGINLPRTSAEQARMGTPVARSELQPGDMVFFRTLGGSRISHVGLYIGNNRF |
| zo013 | 225 | 152 | MQBIFKRAMGINLPRTSAEQARMGTPVARSELQPGDMVFFRTLGGSRISHVGLYIGNNRF |
| zo003 | 225 | 152 | MQBIFKRAMGINLPRTSAEQARMGTPVARSELQPGDMVFFRTLGGSRISHVGLYIGNNRF |
| zo015 | 225 | 152 | MQBIFKRAMGINLPRTSAEQARMGTPVARSELQPGDMVFFRTLGGSRISHVGLYIGNNRF |
| fa1090 | | 123 | MQBIFKRAMGINLPRTSAEQARMGAPVARSELQPGDMVFFRTLGGSRISHVGLYIGNNRF |
| zo032 | 225 | 123 | MQBIFKRAMGINLPRTSAEQARMGAPVARSELQPGDMVFFRTLGGSRISHVGLYIGNNRF |
| zo033 | 225 | 123 | MQBIFKRAMGINLPRTSAEQARMGAPVARSELQPGDMVFFRTLGGSRISHVGLYIGNNRF |

| | | |
|---|---|---|
| gnmzq09 | 181 | DRGYQVSKTAAYNLLSPYSHNGILKGPRFVEEQPK* |
| gnmzq31 | 181 | DRGYQVSKAAAYDLLSPYSHNGILKGPRFVEEQPK* |
| fa1090 | 181 | DRGYQVSKTAAYNLLSPYSRNGILKGPRFVEEQPK* |
| gnmzq32 | 181 | DRGYQVSKTAAYNLLSPYSRMGILKGPRFVEEQPK* |
| gnmzq33 | 181 | DRGYQVSKTAAYNLLSPYSHNGILKGPRFVEEQPK* |
| gnmzq01 | 181 | DRGYQVSKTAAYNLLSPYSHNGILKGPRFVEEQPK* |
| gnmzq05 | 181 | DRGYQVSKTAAYNLLSPYSHNGILKGPRFVEEQPK* |
| gnmzq08 | 181 | DRGYQVSKTAAYNLLSPYSHNGILKGPRFVEEQPK* |
| gnmzq02 | 181 | DRGYQVSKTAAYNLLSPYSHNGILKGPRFVEEQPK* |
| gnmzq03 | 181 | DRGYQVSKTAAYNLLSPYSHNGILKGPRFVEEQPK* |
| gnmzq04 | 181 | DRGYQVSKTAAYNLLSPYSHNGILKGPRFVEEQPK* |
| gnmzq07 | 181 | DRGYQVSKTAAYNLLSPYSHNGILKGPRFVEEQPK* |
| gnmzq10 | 181 | DRGYQVSKTAAYNLLSPYSHNGILKGPRFVEEQPK* |
| gnmzq11 | 181 | DRGYQVSKTAAYNLLSPYSHNGILKGPRFVEEQPK* |
| gnmzq13 | 181 | DRGYQVSKTAAYNLLSPYSHNGILKGPRFVEEQPK* |
| gnmzq15 | 181 | DRGYQVSKTAAYNLLSPYSHNGILKGPRFVEEQPK* |
| gnmzq16 | 181 | DRGYQVSKTAAYNLLSPYSHNGILKGPRFVEEQPK* |
| gnmzq17 | 181 | DRGYQVSKTAAYNLLSPYSHNGILKGPRFVEEQPK* |
| gnmzq19 | 181 | DRGYQVSKTAAYNLLSPYSHNGILKGPRFVEEQPK* |
| gnmzq21 | 181 | DRGYQVSKTAAYNLLSPYSHNGILKGPRFVEEQPK* |
| gnmzq22 | 181 | DRGYQVSKTAAYNLLSPYSHNGILKGPRFVEEQPK* |
| gnmzq23 | 181 | DRGYQVSKTAAYNLLSPYSHNGILKGPRFVEEQPK* |
| gnmzq24 | 181 | DRGYQVSKTAAYNLLSPYSHNGILKGPRFVEEQPK* |
| gnmzq25 | 181 | DRGYQVSKTAAYNLLSPYSHNGILKGPRFVEEQPK* |
| gnmzq27 | 181 | DRGYQVSKTAAYNLLSPYSHNGILKGPRFVEEQPK* |
| gnmzq28 | 181 | DRGYQVSKTAAYNLLSPYSHNGILKGPRFVEEQPK* |
| gnmzq29 | 181 | DRGYQVSKTAAYNLLSPYSHNGILKGPRFVEEQPK* |
| z2491 | 181 | DRGYQVSKTAAYNLLSPYSHNGILKGPRFVEEQPK* |
| gnmzq14 | 181 | DRGYQVSKTAAYNLLSPYSHNGILKGPRFVEEQPK* |
| gnmzq18 | 181 | DRGYQVSKTAAYNLLSPYSHNGILKGPRFVEEQPK* |
| gnmzq26 | 181 | DRGYQVSKTAAYNLLSPYSHNGILKGPRFVEEQPK* |

FIG.5

```
287_14    1  MFKRSVIAMACIFALSACGGGGSPDVKSADTLSKPAAPVVE..........
287_2     1  MFKRSVIAMACIFALSACGGGGSPDVKSADTLSKPAAPVVE..........
287_21    1  MFKRSVIAMACIFALSACGGGGSPDVKSADTLSKPAAPVVE..........KETEA
z2491     1  MFKRSVIAMACIFALSACGGGGSPDVKSADTLSKPAAPVVE..........KETEA
287_9     1  MFKRSVIAMACIVALSACGGGGSPDVKSADTLSKPAAPVVEDVGEEVLPKEKKEEA
fa1090    1  MFKRSVIAMACIFPLSACGGGGSPDVKSADTPSKPAAPVVAENAGEGVLPKEKKEEA

287_14   50  KEDAPQAGSQGQGAPSAQGQDMAAVSEENTGNGGAAATDKPKNEDEGAQNDMPQNAADT
287_2    50  KEDAPQAGSQGQGAPSAQGQDMAAVSEENTGNGGAAATDKPKNEDEGAQNDMPQNAADT
287_21   50  KEDAPQAGSQGQGAPSAQGQDMAAVSEENTGNGGAVTADNPKNEDEVAQNDMPQNAAGT
z2491    50  KEDAPQAGSQGQGAPSAQGQDMAAVSEENTGNGGAVTADNPKNEDEVAQNDMPQNAAGT
287_9    61  VSGAPQADF..QDATACKGGQDMAAVSAENTGNGGAATTDNPENKDEGPQNDMPQNAAAT
fa1090   61  AGGAPQADF..QDATAGEGSQDMAAVSAENTGNGGAATTDNPKNEDAGAQNDMPQNAA.

287_14  110  DSLTPNHTPASNMPAGNMENQAPDAGESEQPANQPDMANTADGMQGDDDPSAGGENAGNTA
287_2   110  DSLTPNHTPASNMPAGNMENQAPDAGESEQPANQPDMANTADGMQGDDDPSAGGENAGNTA
287_21  110  DSSTPNHTPDPNWLAGNMENQATDAGESSQPANQPDMANAADGMQGDDDPSAGGQNAGNTA
z2491   110  DSSTPNHTPDPNMLAGNMENQATDAGESSQPANQPDMANAADGMQGDDDPSAGGQNAGNTA
287_9   119  DSSTPNHTPDPNMLAGNQAPDAGESAQPANQPDMANAADGMQGDDDPSAGGQNAGNTA
fa1090  117  DSLTPNHTPAPNMPTRDWGNQAPDAGESAQPANQPDMANAADGMQGDDDPSA.GENAGNTA
```

FIG.5(CONTD.)

```
287_14   170  AQGTNQAENNQTAGSQNPASSTNPSATNSGGDFGRTNVGNSVIIDGPSQNITLTHCKGDS
287_2    170  AQGTNQAENNQTAGSQNPASSTNPSATNSGGDFGRTNVGNSVIIDGPSQNITLTHCKGDS
287_77   170  AQGANQAGNNQAAGSSDPIPASNPAPANGGSNFGRVDLANGVIIDGPSQNITLTHCKGDS
z2491    170  AQGANQAGNNQAAGSSDPIPASNPAPANGGSNFGRVDLKNGVIIDGPSQNITLTHCKGDS
287_9    178  DQKANQAENNQVGGSQNPASSTNPNATNGGSDFGRINYANGIKLDSGSENMTLTHCKDKV
fa1090   117  .ESANQTGNNQPAGSSDSAPASNPAPANGGSDFGRTNVGNSVIIDGPSQNITLTHCKGDS

287_14   230  CSGNNFLDEEVQLKSEFEKLSDADKISNYKKDGKNDKFVGLVADSVQMKGINQYIH
287_2    230  CSGNNFLDEEVQLKSEFEKLSDADKISNYKKDGKNDKFVGLVADSVQMKGINQYIH
287_77   230  CSGNNFLDEEVQLKSEFEKLSDADKISNYKK.....DGKNDKFVGLVADSVQMKGINQYIH
z2491    230  CSGNNFLDEEVQLKSEFEKLSDADKISNYKK.....DGKNDKFVGLVADSVQMKGINQYIH
287_9    238  CDRD.FLDEEAPPKSEFEKLSDEEKINKYKK.....DEQRENFVGLVADRVEKNGTNKYMI
fa1090   176  CNGDNLLDEEAPSKSEFEKLSDEEKIKRYKK.....DEQRENFVGLVADRVKKDGTNKYII

287_14   290  FYKPKP......SFARFRRSARSRRSLPAEMPLIPVNQADTLIVDGEAVSLTGHSGNIFAPEG
287_2    290  FYKPKP......SFARFRRSARSRRSLPAEMPLIPVNQADTLIVDGEAVSLTGHSGNIFAPEG
287_77   286  FYKPKP......SFARFRRSARSRRSLPAEMPLIPVNQADTLIVDGEAVSLTGHSGNIFAPEG
z2491    286  FYKPKP......SFARFRRSARSRRSLPAEMPLIPVNQADTLIVDGEAVSLTGHSGNIFAPEG
287_9    293  IYKDKSASSSARFRRSARSRRSLPAEMPLIPVNQADTLIVDGEAVSLTGHSGNIFAPEG
fa1090   232  FYTDKPPT......RSARSRRSLPAEHPLIPVNQADTLIVDGEAVSLTGHSGNIFAPEG
```

FIG. 5(CONTD.)

| | | | |
|---|---|---|---|
| 287_14 | 348 | NYRYLTYGAEKLPGGSYALRVQGEPSKGEMLAGTAVYNGEVLHFHTENGRPSPSRGRFAA |
| 287_2 | 348 | NYRYLTYGAEKLPGGSYALRVQGEPSKGEMLAGTAVYNGEVLHFHTENGRPSPSRGRFAA |
| 287_21 | 344 | NYRYLTYGAEKLPGGSYALRVQGEPAKGEMLAGAAVYNGEVLHFHTENGRPYPRGRFAA |
| nz2491 | 344 | NYRYLTYGAEKLPGGSYALRVQGEPAKGEMLAGAAVYNGEVLHFHTENGRPYPRGRFAA |
| 287_9 | 353 | NYRYLTYGAEKLSGGSYALSVQGEPAKGEMLAGTAVYNGEVLHFHMENGRPSPSGGRFAA |
| fa1090 | 285 | NYRYLTYGAEKLPGGSYALRVQGEPAKGEMLVGTAVYNGEVLHFHMENGRPYPSGGRFAA |

| | | | |
|---|---|---|---|
| 287_14 | 408 | KVDFGSKSVDGIIDSGDLHMGTQKFKAAIDGNGFKGTWTENGGGDVSGKFYGPAGEEVA |
| 287_2 | 408 | KVDFGSKSVDGIIDSGDLHMGTQKFKAAIDGNGFKGTWTENGGGDVSGKFYGPAGEEVA |
| 287_21 | 404 | KVDFGSKSVDGIIDSGDLHMGTQKFKAAIDGNGFKGTWTENGSGDVSGKFYGPAGEEVA |
| nz2491 | 404 | KVDFGSKSVDGIIDSGDLHMGTQKFKAAIDGNGFKGTWTENGSGDVSGKFYGPAGEEVA |
| 287_9 | 413 | KVDFGSKSVDGIIDSGDLHMGTQKFKAVIDGNGFKGTWTENGGGDVSGRFYGPAGEEVA |
| fa1090 | 345 | KVDFGSKSVDGIIDSGDLHMGTQKFKAAIDGNGFKGTWTENGGGDVSGRFYGPAGEEVA |

| | | | |
|---|---|---|---|
| 287_14 | 468 | GKYSYRPTDAEKGGFGVFAGKKEQD* |
| 287_2 | 468 | GKYSYRPTDAEKGGFGVFAGKKEQD* |
| 287_21 | 464 | GKYSYRPTDAEKGGFGVFAGKKEQD* |
| nz2491 | 464 | GKYSYRPTDAEKGGFGVFAGKKEQD* |
| 287_9 | 473 | GKYSYRPTDAEKGGFGVFAGKKEQD* |
| fa1090 | 405 | GKYSYRPTDAEKGGFGVFAGKKDRD* |

FIG. 6A

| | | |
|---|---|---|
| z2491_519 | 1 | MEFFIILLAAVVFGFKSFVVIPQQEVHVVERLGRFHRALTAGLNILIPFIDRVAYRHSL |
| zv26_519 | 1 | MEFFIILLAAVVFGFKSFVVIPQQEVHVVERLGRFHRALTAGLNILIPFIDRVAYRHSL |
| zv22_519ass | 1 | MEFFIILLAAVVFGFKSFVVIPQQEVHVVERLGRFHRALTAGLNILIPFIDRVAYRHSL |
| fa1090_519 | 1 | MEFFIILLAAVVFGFKSFVVIPQQEVHVVERLGRFHRALTAGLNILIPFIDRVAYRHSL |
| zv32_519 | 1 | MEFFIILLAAVVFGFKSFVVIPQQEVHVVERLGRFHRALTAGLNILIPFIDRVAYRHSL |
| zv11_519 | 1 | MEFFIILLAAVAVFGFKSFVVIPQQEVHVVERLGRFHRALTAGLNILIPFIDRVAYRHSL |
| zv28_519 | 1 | MEFFIILLAAVAVFGFKSFVVIPQQEVHVVERLGRFHRALTAGLNILIPFIDRVAYRHSL |
| zv96_519 | 1 | MEFFIILLAAVAVFGFKSFVVIPQQEVHVVERLGRFHRALTAGLNILIPFIDRVAYRHSL |
| zv02_519 | 1 | MEFFIILLAAVAVFGFKSFVVIPQQEVHVVERLGRFHRALTAGLNILIPFIDRVAYRHSL |
| zv03_519 | 1 | MEFFIILLAAVAVFGFKSFVVIPQQEVHVVERLGRFHRALTAGLNILIPFIDRVAYRHSL |
| zv04_519 | 1 | MEFFIILLVAVAVFGFKSFVVIPQQEVHVVERLGRFHRALTAGLNILIPFIDRVAYRHSL |
| zv05_519 | 1 | MEFFIILLVAVAVFGFKSFVVIPQQEVHVVERLGRFHRALTAGLNILIPFIDRVAYRHSL |
| zv01_519 | 1 | MEFFIILLVAVAVFGFKSFVVIPQQEVHVVERLGRFHRALTAGLNILIPFIDRVAYRHSL |
| zv07_519 | 1 | MEFFIILLVAVAVFGFKSFVVIPQQEVHVVERLGRFHRALTAGLNILIPFIDRVAYRHSL |
| zv12_519 | 1 | MEFFIILLVAVAVFGFKSFVVIPQQEVHVVERLGRFHRALTAGLNILIPFIDRVAYRHSL |
| zv18_519 | 1 | MEFFIILLVAVAVFGFKSFVVIPQQEVHVVERLGRFHRALTAGLNILIPFIDRVAYRHSL |
| zv19_519 | 1 | MEFFIILLVAVAVFGFKSFVVIPQQEVHVVERLGRFHRALTAGLNILIPFIDRVAYRHSL |
| zv21_519ass | 1 | MEFFIILLVAVAVFGFKSFVVIPQQEVHVVERLGRFHRALTAGLNILIPFIDRVAYRHSL |
| zv27_519 | 1 | MEFFIILLVAVAVFGFKSFVVIPQQEVHVVERLGRFHRALTAGLNILIPFIDRVAYRHSL |
| zv20_519ass | 1 | MEFFIILLVAVAVFGFKSFVVIPQQEVHVVERLGRFHRALTAGLNILIPFIDRVAYRHSL |
| zv06_519ass | 1 | MEFFIILLVAVAVFGFKSFVVIPQQEVHVVERLGRFHRALTAGLNILIPFIDRVAYRHSL |
| zv29_519ass | 1 | MEFFIILLAAVAVFGFKSFVVIPQQEVHVVERLGRFHRALTAGLNILIPFIDRVAYRHSL |

FIG. 6A (CONTD.)

| | | |
|---|---|---|
| z2491_519 | 61 | KEIPLDVPSQVCITRDNTQLTVDGIIYFQVTDPKLASYGSSNYIMAITQLAQTTLRSVIG |
| zv26_519 | 61 | KEIPLDVPSQVCITRDNTQLTVDGIIYFQVTDPKLASYGSSNYIMAITQLAQTTLRSVIG |
| zv22_519ass | 61 | KEIPLDVPSQVCITRDNTQLTVDGIIYFQVTDPKLASYGSSNYIMAITQLAQTTLRSVIG |
| fa1090_519 | 61 | KEIPLDVPSQVCITRDNTQLTVDGIIYFQVTDPKLASYGSSNYIMAITQLAQTTLRSVIG |
| zv32_519 | 61 | KEIPLDVPSQVCITRDNTQLTVDGIIYFQVTDPKLASYGSSNYIMAITQLAQTTLRSVIG |
| zv11_519 | 61 | KEIPLDVPSQVCITRDNTQLTVDGIIYFQVTDPKLASYGSSNYIMAITQLAQTTLRSVIG |
| zv28_519 | 61 | KEIPLDVPSQVCITRDNTQLTVDGIIYFQVTDPKLASYGSSNYIMAITQLAQTTLRSVIG |
| zv96_519 | 61 | KEIPLDVPSQVCITRDNTQLTVDGIIYFQVTDPKLASYGSSNYIMAITQLAQTTLRSVIG |
| zv02_519 | 61 | KEIPLDVPSQVCITRDNTQLTVDGIIYFQVTDPKLASYGSSNYIMAITQLAQTTLRSVIG |
| zv03_519 | 61 | KEIPLDVPSQVCITRDNTQLTVDGIIYFQVTDPKLASYGSSNYIMAITQLAQTTLRSVIG |
| zv04_519 | 61 | KEIPLDVPSQVCITRDNTQLTVDGIIYFQVTDPKLASYGSSNYIMAITQLAQTTLRSVIG |
| zv05_519 | 61 | KEIPLDVPSQVCITRDNTQLTVDGIIYFQVTDPKLASYGSSNYIMAITQLAQTTLRSVIG |
| zv01_519 | 61 | KEIPLDVPSQVCITRDNTQLTVDGIIYFQVTDPKLASYGSSNYIMAITQLAQTTLRSVIG |
| zv07_519 | 61 | KEIPLDVPSQVCITRDNTQLTVDGIIYFQVTDPKLASYGSSNYIMAITQLAQTTLRSVIG |
| zv12_519 | 61 | KEIPLDVPSQVCITRDNTQLTVDGIIYFQVTDPKLASYGSSNYIMAITQLAQTTLRSVIG |
| zv18_519 | 61 | KEIPLDVPSQVCITRDNTQLTVDGIIYFQVTDPKLASYGSSNYIMAITQLAQTTLRSVIG |
| zv19_519 | 61 | KEIPLDVPSQVCITRDNTQLTVDGIIYFQVTDPKLASYGSSNYIMAITQLAQTTLRSVIG |
| zv21_519ass | 61 | KEIPLDVPSQVCITRDNTQLTVDGIIYFQVTDPKLASYGSSNYIMAITQLAQTTLRSVIG |
| zv27_519 | 61 | KEIPLDVPSQVCITRDNTQLTVDGIIYFQVTDPKLASYGSSNYIMAITQLAQTTLRSVIG |
| zv20_519ass | 61 | KEIPLDVPSQVCITRDNTQLTVDGIIYFQVTDPKLASYGSSNYIMAITQLAQTTLRSVIG |
| zv06_519ass | 61 | KEIPLDVPSQVCITRDNTQLTVDGIIYFQVTDPKLASYGSSNYIMAITQLAQTTLRSVIG |
| zv29_519ass | 61 | KEIPLDVPSQVCITRDNTQLTVDGIIYFQVTDPKLASYGSSNYIMAITQLAQTTLRSVIG |

```
z2491_519  181 KRARIAESEGRKKIEQINLASGQREAEIQQSEGEAQAAVNASNAEKIARINRAKGEAESLR
zv26_519   181 KRARIAESEGRKKIEQINLASGQREAEIQQSEGEAQAAVNASNAEKIARINRAKGEAESLR
zv22_519ass 181 KRARIAESEGRKKIEQINLASGQREAKIQQSEGEAQAAVNASNAEKIARINRAKGEAESLR
fa1090_519 181 KRARIAESEGRKKIEQINLASGQREAEIQQSEGEAQAAVNASNAEKIARINRAKGEAESLR
zv32_519   181 KRARIAESEGRKKIEQINLASGQREAEIQQSEGEAQAAVNASNAEKIARINRAKGEAESLR
zv11_519   181 KRARIAESEGRKKIEQINLASGQREAEIQQSEGEAQAAVNASNAEKIARINRAKGEAESLR
zv28_519   181 KRARIAESEGRKKIEQINLASGQREAEIQQSEGEAQAAVNASNAEKIARINRAKGEAESLR
zv96_519   181 KRARIAESEGRKKIEQINLASGQREAEIQQSEGEAQAAVNASNAEKIARINRAKGEAESLR
zv02_519   181 KRARIAESEGRKKIEQINLASGQREAEIQQSEGEAQAAVNASNAEKIARINRAKGEAESLR
zv03_519   181 KRARIAESEGRKKIEQINLASGQREAEIQQSEGEAQAAVNASNAEKIARINRAKGEAESLR
zv04_519   181 KRARIAESEGRKKIEQINLASGQREAEIQQSEGEAQAAVNASNAEKIARINRAKGEAESLR
zv05_519   181 KRARIAESEGRKKIEQINLASGQREAEIQQSEGEAQAAVNASNAEKIARINRAKGEAESLR
zv01_519   181 KRARIAESEGRKKIEQINLASGQREAEIQQSEGEAQAAVNASNAEKIARINRAKGEAESLR
zv07_519   181 KRARIAESEGRKKIEQINLASGQREAEIQQSEGEAQAAVNASNAEKIARINRAKGEAESLR
zv12_519   181 KRARIAESEGRKKIEQINLASGQREAEIQQSEGEAQAAVNASNAEKIARINRAKGEAESLR
zv18_519   181 KRARIAESEGRKKIEQINLASGQREAEIQQSEGEAQAAVNASNAEKIARINRAKGEAESLR
zv19_519   181 KRARIAESEGRKKIEQINLASGQREAEIQQSEGEAQAAVNASNAEKIARINRAKGEAESLR
zv21_519ass 181 KRARIAESEGRKKIEQINLASGQREAEIQQSEGEAQAAVNASNAEKIARINRAKGEAESLR
zv27_519   181 KRARIAESEGRKKIEQINLASGQREAEIQQSEGEAQAAVNASNAEKIARINRAKGEAESLR
zv20_519ass 181 KRARIAESEGRKKIEQINLASGQREAEIQQSEGEAQAAVNASNAEKIARINRAKGEAESLR
zv06_519ass 181 KRARIAESEGRKKIEQINLASGQREAEIQQSEGEAQAAVNASNAEKIARINRAKGEAESLR
zv29_519ass 181 KRARIAESEGRKKIEQINLASGQREPEIQQSEGEAQAAVNASNAEKIARINRAKGEAESLR
```

FIG. 6B (CONTD.)

| | | |
|---|---|---|
| zz491_519 | 241 | LVAEANAEAIRQIAAALQTQGGADAVNLKIAEQYVAAFNNLAKESNTLIMPANVADIGSL |
| zv26_519 | 241 | LVAEANAEAIRQIAAALQTQGGADAVNLKIAEQYVAAFNNLAKESNTLIMPANVADIGSL |
| zv22_519ass | 241 | LVAEANAEAIRQIAAALQTQGGADAVNLKIAEQYVAAFNNLAKESNTLIMPANVADIGSL |
| fa1090_519 | 241 | LVAEANAEAIRQIAAALQTQGGADAVNLKIAEQYVAAFNNLAKESNTLIMPANVADIGSL |
| zv32_519 | 241 | LVAEANAEAIRQIAAALQTQGGADAVNLKIAEQYVAAFNNLAKESNTLIMPANVADIGSL |
| zv11_519 | 241 | LVAEANAEAIRQIAAALQTQGGADAVNLKIAEQYVAAFNNLAKESNTLIMPANVADIGSL |
| zv28_519 | 241 | LVAEANAEAIRQIAAALQTQGGADAVNLKIAEQYVAAFNNLAKESNTLIMPANVADIGSL |
| zv96_519 | 241 | LVAEANAEAIRQIAAALQTQGGADAVNLKIAEQYVAAFNNLAKESNTLIMPANVADIGSL |
| zv02_519 | 241 | LVAEANAEAIRQIAAALQTQGGADAVNLKIAEQYVAAFNNLAKESNTLIMPANVADIGSL |
| zv03_519 | 241 | LVAEANAEAIRQIAAALQTQGGADAVNLKIAEQYVAAFNNLAKESNTLIMPANVADIGSL |
| zv04_519 | 241 | LVAEANAEAIRQIAAALQTQGGADAVNLKIAEQYVAAFNNLAKESNTLIMPANVADIGSL |
| zv05_519 | 241 | LVAEANAEAIRQIAAALQTQGGADAVNLKIAEQYVAAFNNLAKESNTLIMPANVADIGSL |
| zv01_519 | 241 | LVAEANAEAIRQIAAALQTQGGADAVNLKIAEQYVAAFNNLAKESNTLIMPANVADIGSL |
| zv07_519 | 241 | LVAEANAEAIRQIAAALQTQGGADAVNLKIAEQYVAAFNNLAKESNTLIMPANVADIGSL |
| zv12_519 | 241 | LVAEANAEAIRQIAAALQTQGGADAVNLKIAEQYVAAFNNLAKESNTLIMPANVADIGSL |
| zv18_519 | 241 | LVAEANAEAIRQIAAALQTQGGADAVNLKIAEQYVAAFNNLAKESNTLIMPANVADIGSL |
| zv19_519 | 241 | LVAEANAEAIRQIAAALQTQGGADAVNLKIAEQYVAAFNNLAKESNTLIMPANVADIGSL |
| zv21_519ass | 241 | LVAEANAEAIRQIAAALQTQGGADAVNLKIAEQYVAAFNNLAKESNTLIMPANVADIGSL |
| zv27_519 | 241 | LVAEANAEAIRQIAAALQTQGGADAVNLKIAEQYVAAFNNLAKESNTLIMPANVADIGSL |
| zv20_519ass | 241 | LVAEANAEAIRQIAAALQTQGGADAVNLKIAEQYVAAFNNLAKESNTLIMPANVADIGSL |
| zv06_519ass | 241 | LVAEANAEAIRQIAAALQTQGGADAVNLKIAEQYVAAFNNLAKESNTLIMPANVADIGSL |
| zv29_519ass | 241 | LVAEANAEAIRQIAAALQTQGGADAVNLKIAEQYVAAFNNLAKESNTLIMPANVADIGSL |

FIG. 6B(CONTD.)

| | | |
|---|---|---|
| z2491_519 | 301 | ISAGMKIIDSSKTAK* |
| zv26_519 | 301 | ISAGMKIIDSSKTAK* |
| zv22_519ass | 301 | ISAGMKIIDSSKTAK* |
| fa1090_519 | 301 | ISAGMKIIDSSKTAK* |
| zv32_519 | 301 | ISAGMKIIDSSKTAK* |
| zv11_519 | 301 | ISAGMKIIDSSKTAK* |
| zv28_519 | 301 | ISAGMKIIDSSKTAK* |
| zv96_519 | 301 | ISAGMKIIDSSKTAK* |
| zv02_519 | 301 | ISAGMKIIDSSKTAK* |
| zv03_519 | 301 | ISAGMKIIDSSKTAK* |
| zv04_519 | 301 | ISAGMKIIDSSKTAK* |
| zv05_519 | 301 | ISAGMKIIDSSKTAK* |
| zv01_519 | 301 | ISAGMKIIDSSKTAK* |
| zv07_519 | 301 | ISAGMKIIDSSKTAK* |
| zv12_519 | 301 | ISAGMKIIDSSKTAK* |
| zv18_519 | 301 | ISAGMKIIDSSKTAK* |
| zv19_519 | 301 | ISAGMKIIDSSKTAK* |
| zv21_519ass | 301 | ISAGMKIIDSSKTAK* |
| zv27_519 | 301 | ISAGMKIIDSSKTAK* |
| zv20_519ass | 301 | ISAGMKIIDSSKTAK* |
| zv06_519ass | 301 | ISAGMKIIDSSKTAK* |
| zv29_519ass | 301 | ISAGMKIIDSNKTAK* |

| | | |
|---|---|---|
| fa1090 | 421 | QKTTGYVWQLLPNGMKPEYRP* |
| zm33asbc | 421 | QKTTGYVWQLLPNGMKPEYRP* |
| zm32asbc | 421 | QKTTGYVWQLLPNGMKPEYRP* |
| zm23asbc | 421 | MKEPGYVWQLLPNGMKPEYRP* |
| zm27bc | 421 | MKEPGYVWQLLPNGMKPEYRP* |
| zm09 | 421 | QKTTGYVWQLLPNGMKPEYRP* |
| zm10 | 421 | QKTTGYVWQLLPNGMKPEYRP* |
| zm24 | 421 | QKTTGYVWQLLPNGMKPEYRP* |
| zm25 | 421 | QKTTGYVWQLLPNGMKPEYRP* |
| zm14 | 421 | QKTTGYVWQLLPNGMKPEYRP* |
| zm04 | 421 | QKTTGIVWQLLPNGMKPEYRP* |
| zm11asbc | 421 | QKTTGYVWQLLPNGMKPEYRP* |
| zm08n | 421 | QKTTGYVWQLLPNGMKPEYRP* |
| zm96 | 421 | QKTTGYVWQLLPNGMKPEYRP* |
| zm01 | 421 | QKTTGYVWQLLPNGMKPEYRP* |
| zm02 | 421 | QKTTGYVWQLLPNGMKPEYRP* |
| zm03 | 421 | QKTTGYVWQLLPNGMKPEYRP* |
| zm07 | 421 | QKTTGYVWQLLPNGMKPEYRP* |
| zm12 | 421 | QKTTGYVWQLLPNGMKPEYRP* |
| zm18 | 421 | QKTTGYVWQLLPNGMKPEYRP* |
| zm19 | 421 | QKTTGYVWQLLPNGMKPEYRP* |
| zm20 | 421 | QKTTGYVWQLLPNGMKPEYRP* |
| zm21 | 421 | QKTTGYVWQLLPNGMKPEYRP* |
| zm06 | 421 | QKTTGYVWQLLPNGMKPEYRP* |
| zm17 | 421 | QKTTGYVWQLLPNGMKPEYRP* |
| zm13 | 421 | QKTTGYVWQLLPNGMKPEYRP* |
| zm05 | 421 | QKTTGYVWQLLPNGMKPEYRP* |
| z2491 | 421 | QKTTGYVWQLLPNGMKPEYRP* |
| zm22 | 421 | QKTTGYVWQLLPNGMKPEYRP* |
| zm26 | 421 | QKTTGYVWQLLPNGMKPEYRP* |
| zm28 | 421 | QKTTGYVWQLLPNGMKPEYRP* |
| zm29asbc | 421 | QKTTGYVWQLLPNGMKPEYRP* |
| zm16 | 421 | QKTTGYVWQLLPNGMKPEYRP* |
| zm15 | 421 | QKTTGYVWQLLPNGMKPEYRP* |
| zm31asbc | 421 | QKTTGYVWQLLPNGMKPEYRP* |

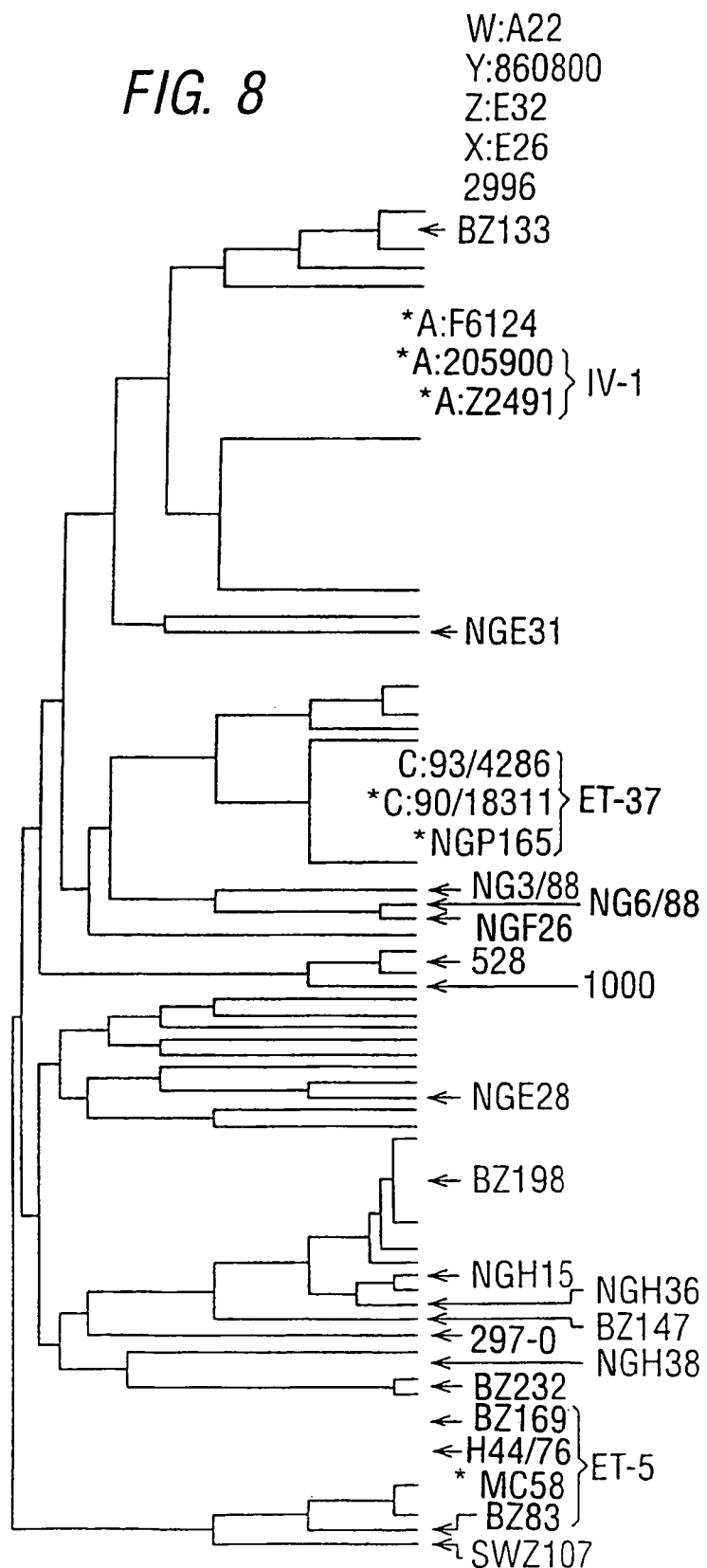

FIG. 10A

ORF 4

ORF 40

| | | |
|---|---|---|
| bz169 | 539 | SMMAIGGGTYRGEAGYAIGYSSISDGGNWIIKGTASGNSRGHFGASASVGYQW* |
| bz83 | 539 | SMMAIGGGTYRGEAGYAIGYSSISDGGNWIIKGTASGNSRGHFGASASVGYQW* |
| 44-76 | 539 | SMMAIGGGTYRGEAGYAIGYSSISDGGNWIIKGTASGNSRGHFGASASVGYQW* |
| mc58 | 539 | SMMAIGGGTYRGEAGYAIGYSSISDGGNWIIKGTASGNSRGHFGASASVGYQW* |
| bz147 | 539 | SMMAIGGGTYRGEAGYAIGYSSISDGGNWIIKGTASGNSRGHFGASASVGYQW* |
| nge28 | 538 | SMMAIGGGTYRGEAGYAIGYSSISDGGNWIIKGTASGNSRGHFGASASVGYQW* |
| ng6-88 | 474 | SMMAIGGGTYRGEAGYAIGYSSISDGGNWIIKGTASGNSRGHFGASASVGYQW* |
| ngf26 | 478 | SMMAIGGGTYRGEAGYAIGYSSISDGGNWIIKGTASGNSRGHFGASASVGYQW* |
| ngh38 | 547 | SMMAIGGGTYRGEAGYAIGYSSISDGGNWIIKGTASGNSRGHFGASASVGYQW* |
| ng3-88 | 542 | SMMAIGGGTYRGEAGYAIGYSSISDGGNWIIKGTASGNSRGHFGASASVGYQW* |
| bz232 | 542 | SMMAIGGGTYRGEAGYAIGYSSISDGGNWIIKGTASGNSRGHFGASASVGYQW* |
| nge31 | 542 | SMMAIGGGTYRGEAGYAIGYSSISDGGNWIIKGTASGNSRGHFGASASVGYQW* |
| ngh15 | 546 | SMMAIGGGTYRGEAGYAIGYSSISDTGNWMIKGTASGNSRGHFGASASVGYQW* |
| 2996 | 546 | SMMAIGGGTYRGEAGYAIGYSSISDTGNWMIKGTASGNSRGHFGTSASVGYQW* |
| bz198 | 542 | SMMAIGGDTYRGEAGYAIGYSSISDGGNWIIKGTASGNSRGHFGASASVGYQW* |
| 297-0 | 542 | SMMAIGGDTYRGEAGYAIGYSSISDGGNWIIKGTASGNSRGHFGASASVGYQW* |
| ngh36 | 546 | SMMAIGGGTYRGEAGYAIGYSSISDGGNWIIKGTASGNSRGHFGASASVGYQW* |
| e26 | 548 | SMMAIGGGTYRGEAGYAIGYSSISDGGNWIIKGTASGNSRGHFGASASVGYQW* |
| bz133 | 540 | SMMAIGGGTYRGEAGYAIGYSSISDGGNWIIKGTASGNSRGHFGASASVGYQW* |
| 205900 | 540 | SMMAIGGGTYRGEAGYAIGYSSISDGGNWIIKGTASGNSRGHFGASASVGYQW* |
| f6124 | 540 | SMMAIGGGTYRGEAGYAIGYSSISDGGNWIIKGTASGNSRGHFGASASVGYQW* |
| z2491 | 540 | SMMAIGGGTYRGEAGYAIGYSSISDGGNWIIKGTASGNSRGHFGASASVGYQW* |
| 860800 | 540 | SMMAIGGGTYRGEAGYAIGYSSISDGGNWIIKGTASGNSRGHFGASASVGYQW* |
| 1000 | 543 | SMMAIGGGTYRGEAGYAIGYSSISDGGNWIIKGTASGNSRGHFGASASVGYQW* |
| 528 | 543 | SMMAIGGGTYRGEAGYAIGYSSISDGGNWIIKGTASGNSRGHFGASASVGYQW* |
| ngp165 | 537 | SMMAIGGGTYRGEAGYAIGYSSISDTGNWMIKGTASGNSRGHFGTSASVGYQW* |
| 90-18311 | 537 | SMMAIGGGTYRGEAGYAIGYSSISDTGNWMIKGTASGNSRGHFGTSASVGYQW* |
| 93-4286 | 537 | SMMAIGGGTYRGEAGYAIGYSSISDTGNWMIKGTASGNSRGHFGTSASVGYQW* |
| swz107 | 546 | SMMAIGGGTYRGEAGYAIGYSSISDGGNWIIKGTASGNSRGHFGASASVGYQW* |
| a22 | 547 | SMMAIGGGTYRGEAGYAIGYSSISDGGNWIIKGTASGNSRGHFGASASVGYQW* |
| e32 | 548 | SMMAIGGGTYRGEAGYAIGYSSISDGGNWIIKGTASGNSRGHFGASASVGYQW* |

ORF46

```
BZ133    1   LGISRKISLILSILAVCLPMHAHASDLANDSFIRQVLDRQHFEPDGKYHLFGSRGELAER
BZ232    1   - - - -RKISLILSILAVCLPMHAHASDLANDSFIRQVLDRQHFEPDGKYHLFGSRGELAER
1000     1   - - - - -KISLILSILAVCLPMHAHASDLANDSFIRQVLDRQHFEPDGKYHLFGSRGELAER
NGH38    1   LGISRKISLILSILAVCLPMHAHASDLANDSFIRQVLDRQHFEPDGKYHLFGSRGELAER
2996     1   LGISRKISLILSILAVCLPMHAHASDLANDSFIRQVLDRQHFEPDGKYHLFGSRGELAER
MC58     1   LGISRKISLILSILAVCLPMHAHASDLANDSFIRQVLDRQHFEPDGKYHLFGSRGELAER

BZ133   61   SGHIGLGNIQSHQLGNLMIQQAAIKGNIGYIVRFSDHGHEVHSPFDNHASHSDSDEAGSP
BZ232   57   SGHIGLGKIQSHQLGNLFIQQAAIKGNIGYIVRFSDHGHEVHSPFDNHASHSDSDEAGSP
1000    56   SGHIGLGNIQSHQLGNLMIQQAAIKGNIGYIVRFSDHGHEVHSPFDNHASHSDSDEAGSP
NGH38   61   SGHIGLGNIQSHQLGNLMIQQAAIKGNIGYIVRFSDHGHEVHSPFDNHASHSDSDEAGSP
2996    61   SGHIGLGKIQSHQLGNLMIQQAAIKGNIGYIVRFSDHGHEVHSPFDNHASHSDSDEAGSP
MC58    61   SGHIGLGKIQSHQLGNLMIQQAAIKGNIGYIVRFSDHGHEVHSPFDNHASHSDSDEAGSP

BZ133  121   VDGFSLYRIHWDGYEHHPADGYDGPQGGGYPVPKGARDIYSYDIKGVAQNIRLNLTDNRS
BZ232  117   VDGFSLYRIHWDGYEHHPADGYDGPQGGGYPAPKGARDIYSYDIKGVAQNIRLNLTDNRS
1000   116   VDGFSLYRIHWDGYEHHPADGYDGPQGGGYPAPKGARDIYSYDIKGVAQNIRLNLTDNRS
NGH38  121   VDGFSLYRIHWDGYEHHPADGYDGPQGGGYPAPKGARDIYSYDIKGVAQNIRLNLTDNRS
2996   121   VDGFSLYRIHWDGYEHHPADGYDGPQGGGYPAPKGARDIYSYDIKGVAQNIRLNLTDNRS
MC58   121   VDGFSLYRIHWDGYEHHPADGYDGPQGGGYPAPKGARDIYSYDIKGVAQNIRLNLTDNRS
```

FIG. 12A(CONTD.)

```
BZ133    181  TGQRLADRFHNAGAMLTQGVGDGFKRATRYSPELDRSGNAAEAFNGTADIVKNIIGAAGE
BZ232    177  TGQRLADRFHNAGAMLTQGVGDGFKRATRYSPELDRSGNAAEAFNGTADIVKNIIGAAGE
1000     176  TGQRLADRFHNAGAMLTQGVGDGFKRATRYSPELDRSGNAAEAFNGTADIVKNIIGAAGE
NGH38    181  TGQRLADRFHNAGAMLTQGVGDGFKRATRYSPELDRSGNAAEAFNGTADIVKNIIGAAGE
2996     181  TGQRLADRFHNAGAMLTQGVGDGFKRATRYSPELDRSGNAAEAFNGTADIVKNIIGAAGE
MC58     181  TGQRLADRFHNAGSMLTQGVGDGFKRATRYSPELDRSGNAAEAFNGTADIVKNIIGAAGE

BZ133    241  IVGAGDAVQGISEGSNIAVMHGLGLLSTENKMARINDLADMAQLKDYAAAAIRDWAVQNP
BZ232    237  IVGAGDAVQGISEGSNIAVMHGLGLLSTENKMARINDLADMAQLKDYAAAAIRDWAVQNP
1000     236  IVGAGDAVQGISEGSNIAVMHGLGLLSTENKMARINDLADMAQLKDYAAAAIRDWAVQNP
NGH38    241  IVGAGDAVQGISEGSNIAVMHGLGLLSTENKMARINDLADMAQLKDYAAAAIRDWAVQNP
2996     241  IVGAGDAVQGISEGSNIAVMHGLGLLSTENKMARINDLADMAQLKDYAAAAIRDWAVQNP
MC58     241  IVGAGDAVQGISEGSNIAVMHGLGLLSTENKMARINDLADMAQLKDYAAAAIRDWAVQNP

BZ133    301  NAAQGIEAVSNIFTAVIPIKGIGAVRGKYGLGGITAHPVKRSQMGAIALPKGKSAVSNNF
BZ232    297  NAAQGIEAVSNIFTAVIPVKGIGAVRGKYGLGGITAHPVKRSQMGAIALPKGKSAVSNNF
1000     296  NAAQGIEAVSNIFMAAIPIKGIGAVRGKYGLGGITAHPIKRSQMGAIALPKGKSAVSDNF
NGH38    301  NAAQGIEAVSNIFMAAIPIKGIGAVRGKYGLGGITAHPIKRSQMGAIALPKGKSAVSDNF
2996     301  NAAQGIEAVSNIFMAAIPIKGIGAVRGKYGLGGITAHPIKRSQMGAIALPKGKSAVSDNF
MC58     301  NAAQGIEAVSNIFMAAIPIKGIGAVRGKYGLGGITAHPIKRSQMGAIALPKGKSAVSDNF
```

FIG. 12A(CONTD.)

```
BZ133   361  ADAAYAKYPSPYHSRNIRSNLEQRYGKENITSSTVPPSNGKNVKLADQRHPKTGVPFDGK
BZ232   357  ADAAYAKYPSPYHSRNIRSNLEQRYGKENITSSTVPPSNGKNVKLADQRHPKTGVPFDGK
1000    356  ADAAYAKYPSPYHSRNIRSNLEQRYGKENITSSTVPPSNGKNVKLADQRHPKTGVPFDGK
NGH38   361  ADAAYAKYPSPYHSRNIRSNLEQRYGKENITSSTVPPSNGKNVKLADQRHPKTGVPFDGK
2996    361  ADAAYAKYPSPYHSRNIRSNLEQRYGKENITSSTVPPSNGKNVKLADQRHPKTGVPFDGK
MC58    361  ADAAYAKYPSPYHSRNIRSNLEQRYGKENITSSTVPPSNGKNVKLADQRHPKTGVPFDGK

BZ133   421  GFPNFEKHVKYDTKLDIQELSGGGIPKAKPVFDAKPRWEVDRKLNKLTTREQVEKNVQEI
BZ232   417  GFPNFEKHVKY-------------------------------------------------
1000    416  GFPNFEKH----------------------------------------------------
NGH38   421  GFPNFEKHVKYDTKLDIQELSGGGIPKAKPVSDAKPRWEVDRKLNKLTTREQVEKNVQEI
2996    421  GFPNFEKHVKYDTKLDIQELSGGGIPKAKPVSDAKPRWEVDRKLNKLTTREQVEKNVQEI
MC58    421  GFPNFEKHVKYDTKLDIQELSGGGIPKAKPVFDAKPRWEVDRKLNKLTTREQVEKNVQEI

BZ133   481  RNGNKNSNFSQHAQLEREINKLKSADEINFADGMGKFTDSMNDKAFSRLVKSVKENGFTN
BZ232   428  RNGNKNSNFNQHAQLEREINKLKSADEINFADGMGKFTDSMDDKAFSRLVKSVKENGFTN
1000    424  RNGNKNSNFSQHAQLEREINKLKSADEINFADGMGKFTDSMDDKAFSRLVKSVKENGFTN
NGH38   481  RNGNKNSNFSQHAQLEREINKLKSADEINFADGMGKFTDSMNDKAFSRLVKSVKENGFTN
2996    481  RNGNKNSNFSQHAQLEREINKLKSADEINFADGMGKFTDSMNDKAFSRLVKSVKENGFTN
MC58    481  RNGNINSNFSQHAQLEREINKLKSADEINFADGMGKFTDSMNDKAFSRLVKSVKENGFTN
```

FIG. 12B

```
BZ133   541  PVVEYVEINGKAYIVRGNNRVFAAEYLGRIHELKFKKVDFPVPNTSWKNPTDVLNESGNV
BZ232   428  ------------------------------------------------------------
1000    424  ------------------------------------------------------------
NGH38   541  PVVEYVEINGKAYIVRGNNRVFAAEYLGRIHELKFKKVDFPVPNTSWKNPTDVLNESGNV
2996    541  PVVEYVEINGKAYIVRGNNRVFAAEYLGRIHELKFKKVDFPVPNTSWKNPTDVLNESGNV
MC58    541  PVVEYVEINGKAYIVRGNNRVFAAEYLGRIHELKFKKVDFPVPNTSWKNPTDVLNESGNV

BZ133   601  KRPRYRSK
BZ232   428  --------
1000    424  --------
NGH38   601  KRPRYRSK
2996    601  KRPRYRSK
MC58    601  KRPRYRSK
```

FIG. 13A

```
                    225
Ng-F62      1  MDSFFKPAVWAVLWLMFAVRPALADELTNLLSSREQILRQFAEDEQPVLPINRAPARRAGNADELIGSAMGLNE.........
FA1090      1  MDSFFKPAVWAVLWLMFAVRPALADELTNLLSSREQILRQFAEDEQPVLPINRAPARRAGNADELIGSAMGLNE.........
1000        1  MDSFFKPAVWAVLWLMFAVRPALADELTNLLSSREQILRQFAEDEQPVLPINRAPARRAGNADELIGSAMGLNE.........
528         1  MDSFFKPAVWAVLWLMFAVRPALADELTNLLSSREQILRQFAEDEQPVLPINRAPARRAGNADELIGSAMGLNEQPVLPV...
NGE31       1  MDSFFKPAVWAVLWLMFAVRPALADELTNLLSSREQILRQFAEDEQPVLPINRAPARRAGNADELIGSAMGLNEQPVLPV...
Z2491       1  MDSFFKPAVWAVLWLMFAVRPALADELTNLLSSREQILRQFAEDEQPVLPINRAPARRAGNADELIGSAMGLNEQPVLPI...
44-76       1  MDSFFKPAVWAVLWLMFAVRPALADELTNLLSSREQILRQFAEDEQPVLPINRAPARRAGNADELIGSAMGLNE.........
NG6-88      1  MDSFFKPAVWAVLWLMFAVRPALADELTNLLSSREQILRQFAEDEQPVLPINRAPARRAGNADELIGSAMGLNE.........
NGP165      1  MDSFFKPAVWAVLWLMFAVRPALADELTNLLSSREQILRQFAEDEQPVLPINRAPARRAGNADELIGSAMGLNE.........
NGF26       1  MDSFFKPAVWAVLWLMFAVRPALADELTNLLSSREQILRQFAEDEQPVLPINRAPARRAGNADELIGSAMGLNE.........
2996        1  MDSFFKPAVWAVLWLMFAVRPALADELTNLLSSREQILRQFAEDEQPVLPINRAPARRAGNADELIGSAMGLNE.........
205900      1  MDSFFKPAVWAVLWLMFAVRPALADELTNLLSSREQILRQFAEDEQPVLPINRAPARRAGNADELIGSAMGLNE.........
F6124       1  MDSFFKPAVWAVLWLMFAVRPALADELTNLLSSREQILRQFAEDEQPVLPINRAPARRAGNADELIGSAMGLNE.........
90-18311    1  MDSFFKPAVWAVLWLMFAVRPALADELTNLLSSREQILRQFAEDEQPVLPINRAPARRAGNADELIGSAMGLNE.........
93-4286     1  MDSFFKPAVWAVLWLMFAVRPALADELTNLLSSREQILRQFAEDEQPVLPINRAPARRAGNADELIGSAMGLNE.........
A22         1  MDSFFKPAVWAVLWLMFAVRPALADELTNLLSSREQILRQFAEDEQPVLPINRAPARRAGNADELIGSAMGLNE.........
BZ198       1  MDSFFKPAVWAVLWLMFAVRPALADELTNLLSSREQILRQFAEDEQPVLPINRAPARRAGNADELIGSAMGLNE.........
297-0       1  MDSFFKPAVWAVLWLMFAVRPALADELTNLLSSREQILRQFAEDEQPVLPINRAPARRAGNADELIGSAMGLNE.........
BZ147       1  MDSFFKPAVWAVLWLMFAVRPALADELTNLLSSREQILRQFAEDEQPVLPINRAPARRAGNADELIGSAMGLNE.........
BZ169       1  MDSFFKPAVWAVLWLMFAVRPALADELTNLLSSREQILRQFAEDEQPVLPINRAPARRAGNADELIGSAMGLNE.........
BZ133       1  MDSFFKPAVWAVLWLMFAVRPALADELTNLLSSREQILRQFAEDEQPVLPINRAPARRAGNADELIGSAMGLNE.........
NGH38       1  MDSFFKPAVWAVLWLMFAVRPALADELTNLLSSREQILRQFAEDEQPVLPINRAPARRAGNADELIGSAMGLNE.........
NGH15       1  MDSFFKPAVWAVLWLMFAVRPALADELTNLLSSREQILRQFAEDEQPVLPINRAPARRAGNADELIGSAMGLNE.........
NGH36       1  MDSFFKPAVWAVLWLMFAVRPALADELTNLLSSREQILRQFAEDEQPVLPINRAPARRAGNADELIGSAMGLNE.........
BZ232       1  MDSFFKPAVWAVLWLMFAVRPALADELTNLLSSREQILRQFAEDEQPVLPINRAPARRAGNADELIGSAMGLNE.........
BZ83        1  MDSFFKPAVWAVLWLMFAVRPALADELTNLLSSREQILRQFAEDEQPVLPINRAPARRAGNADELIGSAMGLNE.........
MC58        1  MDSFFKPAVWAVLWLMFAVRPALADELTNLLSSREQILRQFAEDEQPVLPINRAPARRAGNADELIGSAMGLNE.........
E26         1  MDSFFKPAVWAVLWLMFAVRPALADELTNLLSSREQILRQFAEDEQPVLPINRAPARRAGNADELIGSAMGLNE.........
860800      1  MDSFFKPAVWAVLWLMFAVRPALADELTNLLSSREQILRQFAEDEQPVLPINRAPARRAGNADELIGSAMGLNE.........
E32         1  MDSFFKPAVWAVLWLMFAVRPALADELTNLLSSREQILRQFAEDEQPVLPINRAPARRAGNADELIGSAMGLNE.........
NGE28       1  MDSFFKPAVWAVLWLMFAVRPALADELTNLLSSREQILRQFAEDEQPVLPINRAPARRAGNADELIGSAMGLNE.........
NG3-88      1  MDSFFKPAVWAVLWLMFAVRPLALADELTNLLSSREQILRQFAEDEQPVLPINRAPARRAGNADELIGSAMGLNE.........
SWZ107      1  MDSFFKPAVWAVLWLMFAVRSALADELTNLLSSREQILRQFAEDEQPVLPINRAPARRAGNADELIGSAMGLNE.........
Ng-SN4      1  MDSFFKPAVWAVLWLMFAVRSALADELTNLLSSREQILRQFAEDEQPVLPINRAPARRAGNADELIGSAMGLNE.........
```

| | | |
|---|---|---|
| Ng-F62 | 183 | IHAPRTGKNIEITSLSHKYWSGKYAFARRVKKNDPSRFLN* |
| FA1090 | 183 | IHAPRTGKNIEITSLSHKYWSGKYAFARRVKKNDPSRFLN* |
| 1000 | 212 | IHAPRTGKNIEITSLSHKYWSGKYAFARRVKKNDPSRFLN* |
| 528 | 212 | IHAPRTGKNIEITSLSHKYWSGKYAFARRVKKNDPSRFLN* |
| NGE31 | 241 | IHAPRTGKNIEITSLSHKYWSGKYAFARRVKKNDPSRFLN* |
| Z2491 | 241 | IHAPRTGKNIEITSLSHKYWSGKYAFARRVKKNDPSRFLN* |
| 44-76 | 241 | IHAPRTGKNIEITSLSHKYWSGKYAFARRVKKNDPSRFLN* |
| NG6-88 | 212 | IHAPRTGKNIEITSLSHKYWSGKYAFARRVKKNDPSRFLN* |
| NGP165 | 212 | IHAPRTGKNIEITSLSHKYWSGKYAFARRVKKNDPSRFLN* |
| NGF26 | 212 | IHAPRTGKNIEITSLSHKYWSGKYAFARRVKKNDPSRFLN* |
| 2996 | 212 | IHAPRTGKNIEITSLSHKYWSGKYAFARRVKKNDPSRFLN* |
| 205900 | 212 | IHAPRTGKNIEITSLSHKYWSGKYAFARRVKKNDPSRFLN* |
| F6124 | 212 | IHAPRTGKNIEITSLSHKYWSGKYAFARRVKKNDPSRFLN* |
| 90-18311 | 212 | IHAPRTGKNIEITSLSHKYWSGKYAFARRVKKNDPSRFLN* |
| 93-4286 | 212 | IHAPRTGKNIEITSLSHKYWSGKYAFARRVKKNDPSRFLN* |
| A22 | 212 | IHAPRTGKNIEITSLSHKYWSGKYAFARRVKKNDPSRFLN* |
| BZ198 | 212 | IHAPRTGKNIEITSLSHKYWSGKYAFARRVKKNDPSRFLN* |
| 297-0 | 212 | IHAPRTGKNIEITSLSHKYWSGKYAFARRVKKNDPSRFLN* |
| BZ147 | 212 | IHAPRTGKNIEITSLSHKYWSGKYAFARRVKKNDPSRFLN* |
| BZ169 | 212 | IHAPRTGKNIEITSLSHKYWSGKYAFARRVKKNDPSRFLN* |
| BZ133 | 212 | IHAPRTGKNIEITSLSHKYWSGKYAFARRVKKNDPSRFLN* |
| NGH38 | 212 | IHAPRTGKNIEITSLSHKYWSGKYAFARRVKKNDPSRFLN* |
| NGH15 | 212 | IHAPRTGKNIEITSLSHKYWSGKYAFARRVKKNDPSRFLN* |
| NGH36 | 212 | IHAPRTGKNIEITSLSHKYWSGKYAFARRVKKNDPSRFLN* |
| BZ232 | 212 | IHAPRTGKNIEITSLSHKYWSGKYAFARRVKKNDPSRFLN* |
| BZ83 | 212 | IHAPRTGKNIEITSLSHKYWSGKYAFARRVKKNDPSRFLN* |
| MC58 | 212 | IHAPRTGKNIEITSLSHKYWSGKYAFARRVKKNDPSRFLN* |
| E26 | 212 | IHAPRTGKNIEITSLSHKYWSGKYAFARRVKKNDPSRFLN* |
| 860800 | 212 | IHAPRTGKNIEITSLSHKYWSGKYAFARRVKKNDPSRFLN* |
| E32 | 212 | IHAPRTGKNIEITSLSHKYWSGKYAFARRVKKNDPSRFLN* |
| NGE28 | 212 | IHAPRTGKNIEITSLSHKYWSGKYAFARRVKKNDPSRFLN* |
| NG3-88 | 212 | IHAPRTGKNIEITSLSHKYWSGKYAFARRVKKNDPSRFLN* |
| SWZ107 | 183 | IHAPRTGKNIEITSLSHKYWSGKYAFARRVKKNDPSRFLN* |
| Ng-SN4 | 183 | IHAPRTGKNIEITSLSHKYWSGKYAFARRKKKNDPSRFLN* |

| | | |
|---|---|---|
| 2996 | 105 | . . . . . . . . . . . . . . . . . . . . . . . . . . . . . . . . . . . . . . . . . . . . . . . . . . . . . . . . . . . . . . . . . . . . . . . . . . . . . . . |
| 93-4286 | 105 | . . . . . . . . . . . . . . . . . . . . . . . . . . . . . . . . . . . . . . . . . . . . . . . . . . . . . . . . . . . . . . . . . . . . . . . . . . . . . . . |
| BZ133 | 105 | . . . . . . . . . . . . . . . . . . . . . . . . . . . . . . . . . . . . . . . . . . . . . . . . . . . . . . . . . . . . . . . . . . . . . . . . . . . . . . . |
| SWZ107 | 105 | . . . . . . . . . . . . . . . . . . . . . . . . . . . . . . . . . . . . . . . . . . . . . . . . . . . . . . . . . . . . . . . . . . . . . . . . . . . . . . . |
| A22 | 106 | . . . . . . . . . . . . . . . . . . . . . . . . . . . . . . . . . . . . . . . . . . . . . . . . . . . . . . . . . . . . . . . . . . . . . . . . . . . . . . . |
| E26 | 105 | . . . . . . . . . . . . . . . . . . . . . . . . . . . . . . . . . . . . . . . . . . . . . . . . . . . . . . . . . . . . . . . . . . . . . . . . . . . . . . AGNT |
| 1000 | 105 | . . . . . . . . . . . . . . . . . . . . . . . . . . . . . . . . . . . . . . . . . . . . . . . . . . . . . . . . . . . . . . . . . . . . . . . . . . . . . . AGNT |
| 528 | 105 | . . . . . . . . . . . . . . . . . . . . . . . . . . . . . . . . . . . . . . . . . . . . . . . . . . . . . . . . . . . . . . . . . . . . . . . . . . . . . . AGNT |
| E32 | 105 | . . . . . . . . . . . . . . . . . . . . . . . . . . . . . . . . . . . . . . . . . . . . . . . . . . . . . . . . . . . . . . . . . . . . . . . . . . . . . . AGNT |
| NG6-88 | 105 | . . . . . . . . . . . . . . . . . . . . . . . . . . . . . . . . . . . . . . . . . . . . . . . . . . . . . . . . . . . . . . . . . . . . . . . . . . . . . . AGNT |
| NGE31 | 105 | . . . . . . . . . . . . . . . . . . . . . . . . . . . . . . . . . . . . . . . . . . . . . . . . . . . . . . . . . . . . . . . . . . . . . . . . . . . . . . AGNT |
| NGF26 | 105 | . . . . . . . . . . . . . . . . . . . . . . . . . . . . . . . . . . . . . . . . . . . . . . . . . . . . . . . . . . . . . . . . . . . . . . . . . . . . . . AGNT |
| 860800 | 105 | . . . . . . . . . . . . . . . . . . . . . . . . . . . . . . . . . . . . . . . . . . . . . . . . . . . . . . . . . . . . . . . . . . . . . . . . . . . . . . AGNT |
| NGH15 | 105 | . . . . . . . . . . . . . . . . . . . . . . . . . . . . . . . . . . . . . . . . . . . . . . . . . . . . . . . . . . . . . . . . . . . . . . . . . . . . . . . |
| C11 | 109 | TDSLTPNHTPASNMPAGNMENQAPDAGESEQPANQPDMANTADGMQGDDPSAGGENAGNT |
| BZ198 | 109 | TDSLTPNHTPASNMPAGNMENQAPDAGESEQPANQPDMANTADGMQGDDPSAGGENAGNT |
| NGH38 | 109 | TDSSTPNHTPDPNMLAGNMENQATDAGESSQPANQPDMANAADGMQGDDPSAGGQNAGNT |
| BZ169 | 109 | TDSSTPNHTPDPNMLAGNMENQATDAGESSQPANQPDMANAADGMQGDDPSAGGQNAGNT |
| BZ83 | 109 | TDSSTPNHTPDPNMLAGNMENQATDAGESSQPANQPDMANAADGMQGDDPSAGGQNAGNT |
| H44-76 | 109 | TDSSTPNHTPDPNMLAGNMENQATDAGESSQPANQPDMANAADGMQGDDPSAGGQNAGNT |
| MC58 | 109 | TDSLTPNHTPASNMPAVNMENQAPDTGESVQPANQPDMANAADGMQGDDPSAGGENAGNT |
| NG3-88 | 109 | TDSLTPNHTPASNMPAGNMENQAPDAGESEQPANQPDMANTADGMQGDDPSAGGENAGNT |
| NGH36 | 109 | TDSLTPNHTPAPNMPAGNMENQATDAGESEQPANQPDMANAADGMQGDDPSAGGENAGNT |
| BZ147 | 109 | TDSLTPNHTPAPNMPTGDMGNQAPDYGESAQPENQPDAANAGDGIQGDDPSAGGENAGNT |
| NGE28 | 109 | TDSLTPNHTPAPNMPTGDMGNQAPDYGESAQPENQPDAANAGDGIQGDDPSAGGENAGNT |
| FA1090 | 117 | . . . . . . . . . . . . . . . . . . . . . . . . . . . . . . . . . . . . . . . . . . . . . . . . . . . . . . . . . . . . . . . . . . . . . . GENAGNT |
| NG-F62 | 117 | . . . . . . . . . . . . . . . . . . . . . . . . . . . . . . . . . . . . . . . . . . . . . . . . . . . . . . . . . . . . . . . . . . . . . . GENAGNT |
| 205900 | 118 | TDSSTPNHTPAPNMPTRDMGNQAPDAGESAQPANQPDMANAADGMQGDDPSA.GENAGNT |
| 90-18311 | 118 | TDSSTPNHTPAPNMPTRDMGNQAPDAGE3AQPANQPDMANAADGMQGDDPSA.GENAGNT |
| NGP165 | 118 | TDSSTPNHTPAPNMPTRDMGNQAPDAGESAQPANQPDMANAADGMQGDDPSA.GENAGNT |
| Z2491 | 118 | TDSSTPNHTPAPNMPTRDMGNQAPDAGESAQPANQPDMANAADGMQGDDPSA.GENAGNT |
| F6124 | 118 | TDSSTPNHTPAPNMPTRDMGNQAPDAGESAQPANQPDMANAADGMQGDDPSA.GENAGNT |
| 297-0 | 109 | TDSSTPNHTPAPNMPTRDMGNQAPDAGESAQPANQPDMANAADGMQGDDPSA.GENAGNT |
| BZ232 | 118 | TDSSTPNHTPAPNMPAVDMGNQAPDSGESAQPANQPDMANAADGIQGDDPSV.GENAGNT |
| N_lactam | 118 | TDSLTPNYTTAPNMPAVDMGNQAPDSGESAQPANQPDMANAADGIQGDDPSV.GENAGNT |

| | | |
|---|---|---|
| 2996 | 402 | AGKYSYRPTDAEKGGFGVFAGKKEQD |
| 93-4286 | 402 | AGKYSYRPTDAEKGGFGVFAGKKEQD |
| BZ133 | 402 | AGKYSYRPTDAEKGGFGVFAGKKEQD |
| SWZ107 | 402 | AGKYSYRPTDAEKGGFGVFAGKKEQD |
| A22 | 403 | AGKYSYRPTDAEKGGFGVFAGKKEQD |
| E26 | 400 | AGKYSYRPTDAEKGGFGVFAGKKEQD |
| 1000 | 401 | AGKYSYRPTDAEKGGFGVFAGKKEQD |
| 528 | 401 | AGKYSYRPTDAEKGGFGVFAGKKEQD |
| E32 | 401 | AGKYSYRPTDAEKGGFGVFAGKKEQD |
| NG6-88 | 401 | AGKYSYRPTDAEKGGFGVFAGKKEQD |
| NGE31 | 401 | AGKYSYRPTDAEKGGFGVFAGKKEQD |
| NGF26 | 401 | AGKYSYRPTDAEKGGFGVFAGKKEQD |
| 860800 | 401 | AGKYSYRPTDAEKGGFGVFAGKKEQD |
| NGH15 | 394 | AGKYSYRPTDAEKGGFGVFAGKKEQD |
| C11 | 398 | AGKYSYRPTDAEKGGFGVFAGKKEQD |
| BZ198 | 467 | AGKYSYRPTDAEKGGFGVFAGKKEQD |
| NGH38 | 467 | AGKYSYRPTDAEKGGFGVFAGKKEQD |
| BZ169 | 463 | AGKYSYRPTDAEKGGFGVFAGKKEQD |
| BZ83 | 463 | AGKYSYRPTDAEKGGFGVFAGKKEQD |
| H44-76 | 463 | AGKYSYRPTDAEKGGFGVFAGKKEQD |
| MC58 | 463 | AGKYSYRPTDAEKGGFGVFAGKKEQD |
| NG3-88 | 461 | AGKYSYRPTDAEKGGFGVFAGKKEQD |
| NGH36 | 461 | AGKYSYRPTDAEKGGFGVFAGKKEQD |
| BZ147 | 456 | AGKYSYRPTDAEKGGFGVFAGKKEQD |
| NGE28 | 455 | AGKYSYRPTDAEKGGFGVFAGKKEQD |
| FA1090 | 404 | AGKYSYRPTDAEKGGFGVFAGKKDRD |
| NG-F62 | 404 | AGKYSYRPTDAEKGGFGVFAGKKDRD |
| 205900 | 472 | AGKYSYRPTDAEKGGFGVFAGKKEQD |
| 90-18311 | 472 | AGKYSYRPTDAEKGGFGVFAGKKEQD |
| NGP165 | 472 | AGKYSYRPTDAEKGGFGVFAGKKEQD |
| Z2491 | 472 | AGKYSYRPTDAEKGGFGVFAGKKEQD |
| F6124 | 472 | AGKYSYRPTDAEKGGFGVFAGKKEQD |
| 297-0 | 463 | AGKYSYRPTDAEKGGFGVFAGKKEQD |
| BZ232 | 471 | AGKYSYRPTDAEKGGFGVFAGKKEQD |
| N_lactam | 468 | AGKYSYRPTDAEKGGFGVFAGKKEQD |

FIG. 16A

| | 519 |
|---|---|
| NGE28 | 1  MEFFIILLVAVAVFGFKSFVVIPQQEVHVVERLGRFHRALTAGLNILIPFFIDRVAYRHSLKEIPLDVPSQVCITRDNTQL |
| F6124 | 1  MEFFIILLVAVAVFGFKSFVVIPQQEVHVVERLGRFHRALTAGLNILIPFFIDRVAYRHSLKEIPLDVPSQVCITRDNTQL |
| E32 | 1  MEFFIILLVAVAVFGFKSFVVIPQQEVHVVERLGRFHRALTAGLNILIPFFIDRVAYRHSLKEIPLDVPSQVCITRDNTQL |
| NGE31 | 1  MEFFIILLVAVAVFGFKSFVVIPQQEVHVVERLGRFHRALTAGLNILIPFFIDRVAYRHSLKEIPLDVPSQVCITRDNTQL |
| 2996 | 1  MEFFIILLVAVAVFGFKSFVVIPQQEVHVVERLGRFHRALTAGLNILIPFFIDRVAYRHSLKEIPLDVPSQVCITRDNTQL |
| 860800 | 1  MEFFIILLVAVAVFGFKSFVVIPQQEVHVVERLGRFHRALTAGLNILIPFFIDRVAYRHSLKEIPLDVPSQVCITRDNTQL |
| NG6-88 | 1  MEFFIILLVAVAVFGFKSFVVIPQQEVHVVERLGRFHRALTAGLNILIPFFIDRVAYRHSLKEIPLDVPSQVCITRDNTQL |
| BZ169 | 1  MEFFIILLVAVAVFGFKSFVVIPQQEVHVVERLGRFHRALTAGLNILIPFFIDRVAYRHSLKEIPLDVPSQVCITRDNTQL |
| NGF26 | 1  MEFFIILLVAVAVFGFKSFVVIPQQEVHVVERLGRFHRALTAGLNILIPFFIDRVAYRHSLKEIPLDVPSQVCITRDNTQL |
| NGH38 | 1  MEFFIILLVAVAVFGFKSFVVIPQQEVHVVERLGRFHRALTAGLNILIPFFIDRVAYRHSLKEIPLDVPSQVCITRDNTQL |
| SWZ107 | 1  MEFFIILLVAVAVFGFKSFVVIPQQEVHVVERLGRFHRALTAGLNILIPFFIDRVAYRHSLKEIPLDVPSQVCITRDNTQL |
| BZ232 | 1  MEFFIILLVAVAVFGFKSFVVIPQQEVHVVERLGRFHRALTAGLNILIPFFIDRVAYRHSLKEIPLDVPSQVCITRDNTQL |
| BZ83 | 1  MEFFIILLVAVAVFGFKSFVVIPQQEVHVVERLGRFHRALTAGLNILIPFFIDRVAYRHSLKEIPLDVPSQVCITRDNTQL |
| 44-76 | 1  MEFFIILLVAVAVFGFKSFVVIPQQEVHVVERLGRFHRALTAGLNILIPFFIDRVAYRHSLKEIPLDVPSQVCITRDNTQL |
| MC58 | 1  MEFFIILLVAVAVFGFKSFVVIPQQEVHVVERLGRFHRALTAGLNILIPFFIDRVAYRHSLKEIPLDVPSQVCITRDNTQL |
| E26 | 1  MEFFIILLVAVAVFGFKSFVVIPQQEVHVVERLGRFHRALTAGLNILIPFFIDRVAYRHSLKEIPLDVPSQVCITRDNTQL |
| BZ198 | 1  MEFFIILLVAVAVFGFKSFVVIPQQEVHVVERLGRFHRALTAGLNILIPFFIDRVAYRHSLKEIPLDVPSQVCITRDNTQL |
| NG3-88 | 1  MEFFIILLVAVAVFGFKSFVVIPQQEVHVVERLGRFHRALTAGLNILIPFFIDRVAYRHSLKEIPLDVPSQVCITRDNTQL |
| 297-0 | 1  MEFFIILLVAVAVFGFKSFVVIPQQEVHVVERLGRFHRALTAGLNILIPFFIDRVAYRHSLKEIPLDVPSQVCITRDNTQL |
| 1000 | 1  MEFFIILLVAVAVFGFKSFVVIPQQEVHVVERLGRFHRALTAGLNILIPFFIDRVAYRHSLKEIPLDVPSQVCITRDNTQL |
| BZ147 | 1  MEFFIILLVAVAVFGFKSFVVIPQQEVHVVERLGRFHRALTAGLNILIPFFIDRVAYRHSLKEIPLDVPSQVCITRDNTQL |
| 528 | 1  MEFFIILLVAVAVFGFKSFVVIPQQEVHVVERLGRFHRALTAGLNILIPFFIDRVAYRHSLKEIPLDVPSQVCITRDNTQL |
| NGP165 | 1  MEFFIILLVAVAVFGFKSFVVIPQQEVHVVERLGRFHRALTAGLNILIPFFIDRVAYRHSLKEIPLDVPSQVCITRDNTQL |
| NGH15 | 1  MEFFIILLVAVAVFGFKSFVVIPQQEVHVVERLGRFHRALTAGLNILIPFFIDRVAYRHSLKEIPLDVPSQVCITRDNTQL |
| NGH36 | 1  MEFFIILLVAVAVFGFKSFVVIPQQEVHVVERLGRFHRALTAGLNILIPFFIDRVAYRHSLKEIPLDVPSQVCITRDNTQL |
| 90-18311 | 1  MEFFIILLVAVAVFGFKSFVVIPQQEVHVVERLGRFHRALTAGLNILIPFFIDRVAYRHSLKEIPLDVPSQVCITRDNTQL |
| 93-4286 | 1  MEFFIILLAAVAVFGFKSFVVIPQQEVHVVERLGRFHRALTAGLNILIPFFIDRVAYRHSLKEIPLDVPSQVCITRDNTQL |
| Ng-F62 | 1  MEFFIILLAAVAVFGFKSFVVIPQQEVHVVERLGRFHRALTAGLNILIPFFIDRVAYRHSLKEIPLDVPSQVCITRDNTQL |
| Ng-SN4 | 1  MEFFIILLAAVVFGFKSFVVIPQQEVHVVERLGRFHRALTAGLNILIPFFIDRVAYRHSLKEIPLDVPSQVCITRDNTQL |
| FA1090 | 1  MEFFIILLVAVAVFGFKSFVVIPQQEVHVVERLGRFHRALTAGLNILIPFFIDRVAYRHSLKEIPLDVPSQVCITRDNTQL |
| 205900 | 1  MEFFIILLVAVAVFGFKSFVVIPQQEVHVVERLGRFHRALTAGLNILIPFFIDRVAYRHSLKEIPLDVPSQVCITRDNTQL |
| Z2491 | 1  MEFFIILLVAVAVFGFKSFVVIPQQEVHVVERLGRFHRALTAGLNILIPFFIDRVAYRHSLKEIPLDVPSQVCITRDNTQL |
| A22 | 1  MEFFIILLVAVAVFGFKSFVVIPQQEVHVVERLGRFHRALTAGLNILIPFFIDRVAYRHSLKEIPLDVPSQVCITRDNTQL |

1  MTIYFKNGFYDDTLGGIPEGAVAVRAEEYAALLAGQAQGGQIAADSDGRPVLTPPRPSEY
              1  MTIYFKNGFYDDTLGGIPEGAVAVRAEEYAALLAGQAQGGQIAADSDGRPVLTPPRPSEY
              1  MTIYFKNGFYDDTLGSIPEGAVAVRAEEYAALLAGQAQGGQIAADSDGRPVLTPPRPSDY
              1  ---NGFYDDTLGSIPEGAVAVRAEEYAALLAGQAQGGQIAADSDGRPVLTPPRPSDY
              1  MTIYFKNGFYDDTLGGIPEGAVAVRAEEYAALLAGQAQGGQIAADSDGRPVLTPPRPSDY
              1  MTIYFKNGFYDDTLGGIPEGAVAVRAEEYAALLAGQAQGGQIAADSDGRPVLTPPRPSEY
              1  ---ISKTGFYDDTLGSIPEGAVAVRAEEYAALLAGQTQGGQIAADSDGRPVLTPPRPSEY
              1  --IIYFKNGFYDDTLGSIPEGAVAVRAEEYAALLAGQTQGGQIAADSDGRPVLTPPRPSEY

1000
F6124
C11
2996
BZ133
MC58
NGH38
BZ232

61  HEWDGKKWEIGEAAAAARFAEQKTATAFRLAAKADELKNSLLAGYPQVEIDSFYRQEKEA
             61  HEWDGKKWEIGEAAAAARFAEQKTATAFRLAAKADELKNSLLAGYPQVEIDSFYRQEKEA
             61  HEWDGKKWEIGEAAAAARFAEQKTATAFRLAAKADELKNSLLAGYPQVEIDSFYRQEKEA
             55  HEWDGKKWKISKAAAAARFAEQKTATAFRLAAKADELKNSLLAGYPQVEIDSFYRQEKEA
             61  HEWDGKKWKIGKAAAAARFAEQKTATAFRLAAKADELKNSLLAGYPQVEIDSFYRQEKEA
             61  HEWDGKKWKISKAAAAARFAEQKTATAFRLAEKADELKNSLLAGYPQVEIDSFYRQEKEA
             58  HEWDGKKWEIGEAAAAARFAEQKTAKQKTAFRLAAKADELKNSLLAGYPQVEIDSFYRQEKEA
             59  HEWDGKKWEIGEAAAAARFAEQKTATAFRLAAKADELKNSLLAGYPQVEIDSFYRQEKEA

1000
F6124
C11
2996
BZ133
MC58
NGH38
BZ232
```

FIG. 17 (CONTD.)

```
1000   121 LARQADNNAPTPMLAQIAATRGVELDVLIEKVIEKSARLAVAAGAIIGK....RQQLEDK
F6124  121 LARQADNNAPTPMLAQIAATRGVELDVLIEKVIEKSARLAVAAGAIIGK....RQQLEDK
C11    121 LARQADNNAPTPMLAQIAAARGVELDVLIEKVIEKSARLAVAAGAIIGK....RQQLEDK
2996   115 LARQADNNAPTPMLAQIAAARGVELDVLIEKVIEKSARLAVAAGAIIGK....RQQLEDK
BZ133  121 LARQADNNAPTPMLAQIAAARGVELDVLIEKVIEKSARLAVAAGAIIGK....RQQLEDK
MC58   121 LARQADNNAPTPMLAQIAAARGVELDVLIEKVIEKSARLAVAAGAIIGK....RQQLEDK
NGH38  118 LARQADNNAPTPMLAQIAAARGVELDVLIEKVIEKSARLAVAAGAIIGK....RQQLEDK
BZ232  119 LARQADNNAPTPMLAQIAAARGVELDVLIEKVIEKSARLAVAAGAIIGKPAAARRQIHH 1000   177 LNTIETAPGLDALEKEIEEWTLNIG
F6124  177 LNTIETAPGLDALEKEIEEWTLNIG
C11    177 LNTIETAPGLDALEKEIEEWTLNIG
2996   171 LNAIETAPGLDALEKEIEEWTLNIG
BZ133  177 LNTIETAPGLDALEKEIEEWTLNIG
MC58   177 LNTIETAPGLDALEKEIE------
NGH38  174 LNAIETAPGLDALEKEIEEWTLNIG
BZ232  179 RN...PRPGLDALEKEIEEWTA---
```

Sequence alignment beginning at position 201 for strains: Ng-SN4, FA1090, Ng-F62, F6124, E26, NGP165, BZ133, 90-18311, 93-4286, NGH38, 297-0, NCE31, 528, 2996, NG6-88, BZ198, NG3-88, BZ169, NGF26, BZ232, BZ83, 44-76, MC58, BZ147, NGH36, NGE28, 1000, 205900, Z2491, A22, 860800, E32, NGH15, GWZ107, N_lactam.

Consensus sequence (position 201): HTADLSRFPITARTTAIKGRFEGSRFLPYHTRNQINGGALDGKAPILGYAEDPVELFFMHIQGSGRLKTPSGKYIRIGYADKNEHPYVSIGRYMADKGYL

| | | |
|---|---|---|
| Ng-6N4 | 401 | AVRVDYFWGYGDEAGELAGKQKTTGYVWQLLPNGMKPEYRP |
| FA1090 | 401 | AVRVDYFWGYGDEAGELAGKQKTTGYVWQLLPNGMKPEYRP |
| Ng-F62 | 401 | AVRVDYFWGYGDEAGELAGKQKTTGYVWQLLPNGMKPEYRP |
| F6124 | 401 | AVRVDYFWGYGDEAGELAGKMKEPGYVWQLLPNGMKPEYRP |
| E26 | 401 | AVRVDYFWGYGDEAGELAGKMKEPGYVWQLLPNGMKPEYRP |
| NGP165 | 401 | AVRVDYFWGYGDEAGELAGKQKTTGYVWQLLPNGMKPEYRP |
| BZ133 | 401 | AVRVDYFWGYGDEAGELAGKQKTTGYVWQLLPNGMKPEYRP |
| 90-18311 | 401 | AVRVDYFWGYGDEAGELAGKQKTTGYVWQLLPNGMKPEYRP |
| 93-4286 | 401 | AVRVDYFWGYGDEAGELAGKQKTTGYVWQLLPNGMKPEYRP |
| NGH38 | 401 | AVRVDYFWGYGDEAGELAGKQKTTGYVWQLLPNGMKPEYRP |
| 297-0 | 401 | AVRVDYFWGYGDEAGELAGKQKTTGYVWQLLPNGMKPEYRP |
| NGE31 | 401 | AVRVDYFWGYGDEAGELAGKQKTTGYVWQLLPNGMKPEYRP |
| 528 | 401 | AVRVDYFWGYGDEAGELAGKQKTTGYVWQLLPNGMKPEYRP |
| 2996 | 401 | AVRVDYFWGYGDEAGELAGKQKTTGYVWQLLPNGMKPEYRP |
| NG6-88 | 401 | AVRVDYFWGYGDEAGELAGKQKTTGYVWQLLPNGMKPEYRP |
| BZ198 | 401 | AVRVDYFWGYGDEAGELAGKQKTTGYVWQLLPNGMKPEYRP |
| NG3-88 | 401 | AVRVDYFWGYGDEAGELAGKQKTTGYVWQLLPNGMKPEYRP |
| BZ169 | 401 | AVRVDYFWGYGDEAGELAGKQKTTGYVWQLLPNGMKPEYRP |
| NGF26 | 401 | AVRVDYFWGYGDEAGELAGKQKTTGYVWQLLPNGMKPEYRP |
| BZ232 | 401 | AVRVDYFWGYGDEAGELAGKQKTTGYVWQLLPNGMKPEYRP |
| BZ83 | 401 | AVRVDYFWGYGDEAGELAGKQKTTGYVWQLLPNGMKPEYRP |
| 44-76 | 401 | AVRVDYFWGYGDEAGELAGKQKTTGYVWQLLPNGMKPEYRP |
| MC58 | 401 | AVRVDYFWGYGDEAGELAGKQKTTGYVWQLLPNGMKPEYRP |
| BZ147 | 401 | AVRVDYFWGYGDEAGELAGKQKTTGYVWQLLPNGMKPEYRP |
| NGH36 | 401 | AVRVDYFWGYGDEAGELAGKQKTTGYVWQLLPNGMKPEYRP |
| NGE28 | 401 | AVRVDYFWGYGDEAGELAGKQKTTGYVWQLLPNGMKPEYRP |
| 1000 | 401 | AVRVDYFWGYGDEAGELAGKQKTTGYVWQLLPNGMKPEYRP |
| 205900 | 401 | AVRVDYFWGYGDEAGELAGKQKTTGYVWQLLPNGMKPEYRP |
| Z2491 | 401 | AVRVDYFWGYGDEAGELAGKQKTTGYVWQLLPNGMKPEYRP |
| A22 | 401 | AVRVDYFWGYGDEAGELAGKQKTTGYVWQLLPNGMKPEYRP |
| 860800 | 401 | AVRVDYFWGYGDEAGELAGKQKTTGYVWQLLPNGMKPEYRP |
| E32 | 401 | AVRVDYFWGYGDEAGELAGKQKTTGYVWQLLPNGMKPEYRP |
| NGH15 | 401 | AVRVDYFWGYGDEAGELAGKQKTTGYVWQLLPNGMKPEYRP |
| 6WZ107 | 401 | AVRVDYFWGYGDEAGELAGKQKTTGYVWQLLPNGMKPEYRP |
| N_lactam | 401 | AVRVDYFWGYGDEAGELAGKQKTTGYVWQLLPNGMKPEYRP |

FIG. 19

```
             953
1000    1  MKKIIFAALAAIAAAVGTASAATYKVDEYHANARFAIDHFNTSTNVGGFYGLTGSVEFDQAK
C11     1  MKKIIFAALAAIAAAVGTASAATYKVDEYHANARFAIDHFNTSTNVGGFYGLTGSVEFDQAK
2996    1  MKKIIFAALAAIAAAVGTASAATYKVDEYHANARFAIDHFNTSTNVGGFYGLTGSVEFDQAK
BZ133   1  MKKIIFAALAALAAAVGTASAATYKVDEYHANARFAIDHFNTSTNVGGFYGLTGSVEFDQAK
BZ232   1  MKKIIFAALAALAAAVGTASAATYKVDEYHANARFAIDHFNTSTNVGGFYGLTGSVEFDQAK
NGH38   1  MKKIIFAALAALAAATSTASAATYKVDEYHANARFAIDHFNTSTNVGGFYGLTGSVEFDQAK
MC58    1  MKKIIFAALAALAAAHGTASAATYKVDEYHANARFSIDHFNTSTNVGGFYGLTGSVEFDQAK
F6124   1  MKKIIFAALAALAAAAVGTASAATYKVDEYHANARFAIDHFNTSTNVGGFYGLTGSVEFDQAK 1000   61  RDGKIDITIPVANLQSGSQHFTDHLKSADIFDAAQYPDIRFVSTKFNFNGKKLVSVDGNL
C11    61  RDGKIDITIPVANLQSGSQHFTDHLKSADIFDAAQYPDIRFVSTKFNFNGKKLVSVDGNL
2996   61  RDGKIDITIPVANLQSGSQHFTDHLKSADIFDAAQYPDIRFVSTKFNFNGKKLVSVDGNL
BZ133  61  RDGKIDITIPVANLQSGSQHFTDHLKSADIFDAAQYPDIRFVSTKFNFNGKKLVSVDGNL
BZ232  61  RDGKIDITIPVANLQSGSQHFTDHLKSADIFDAAQYPDIRFVSTKFNFNGKKLVSVDGNL
NGH38  61  RDGKIDITIPVANLQSGSQHFTDHLKSADIFDAAQYPDIRFVSTKFNFNGKKLVSVDGNL
MC58   61  RDGKIDITIPUANLQSGSQHFTDHLKSADIFDAAQYPDIRFVSTKFNFNGKKLVSVDGNL
F6124  61  RDGKIDITIPVANLQSGSQHFTDHLKSADIFDAAQYPDIRFVSTKFNFNGKKLVSVDGNL
```

FIG. 19(CONTD.)

| | | |
|---|---|---|
| 1000 | 121 | TMHGKTAPVKLKAEKFNCYQSPMEKTEVCGGDFSTTIDRTKWGVDYLVNVGMTKSVRIDI |
| C11 | 121 | TMHGKTAPVKLKAEKFNCYQSPMEKTEVCGGDFSTTIDRTKWGVDYLVNVGMTKSVRIDI |
| 2996 | 121 | TMHGKTAPVKLKAEKFNCYQSPMAKTEVCGGDFSTTIDRTKWGVDYLVNVGMTKSVRIDI |
| BZ133 | 121 | TMHGKTAPVKLKAEKFNCYQSPMAKTEVCGGDFSTTIDRTKWGVDYLVNVGMTKSVRIDI |
| BZ232 | 121 | TMHGKTAPVKLKAEKFNCYQSPMAKTEVCGGDFSTTIDRTKWGVDYLVNVGMTKSVRIDI |
| NGH38 | 121 | TMHGKTAPVKLKAEKFNCYQSPMAKTEVCGGDFSTTIDRTKWGVDYLVNVGMTKSVRIDI |
| MC58 | 121 | TMHGKTAPVKLKAEKFNCYQSPMEKTEVCGGDFSTTIDRTKWGMDYLVNVGMTKSVRIDI |
| F6124 | 121 | TMHGKTAPVKLKAEKFNCYQSPMLKTEVCGGDFSTTIDRTKWGMDYLVNVGMTKSVRIDI |

| | | |
|---|---|---|
| 1000 | 181 | QIEAAKQ |
| C11 | 181 | QIEAAKQ |
| 2996 | 181 | QIEAAKQ |
| BZ133 | 181 | QIEAAKQ |
| BZ232 | 181 | QIEAAKQ |
| NGH38 | 181 | QIEAAKQ |
| MC58 | 181 | QIEAAKQ* |
| F6124 | 181 | QIEAAKQ |

FIG. 20A Orf 4 (33 kD)
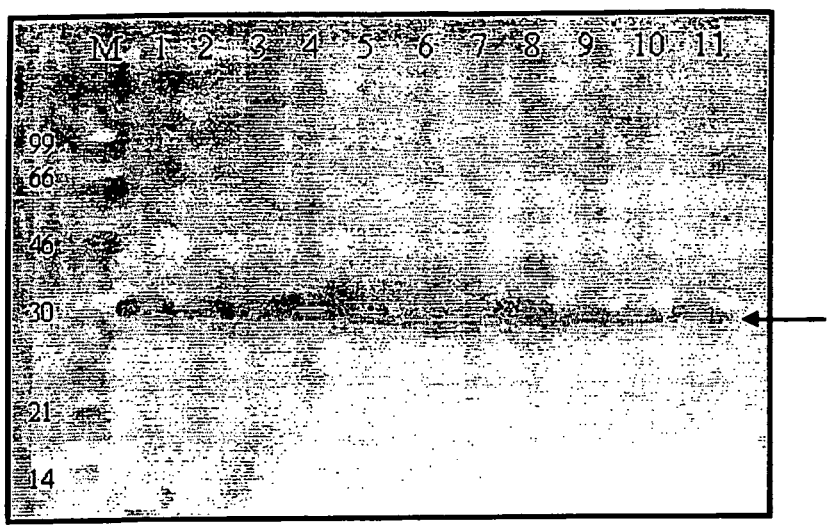
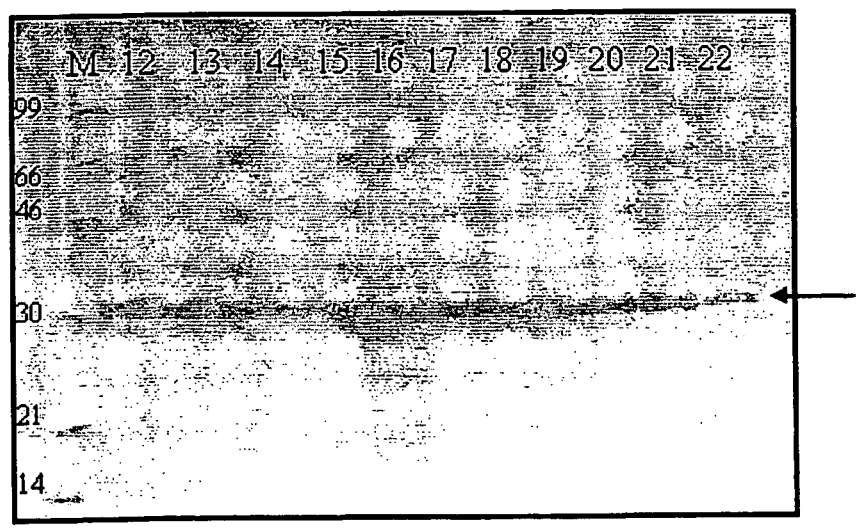
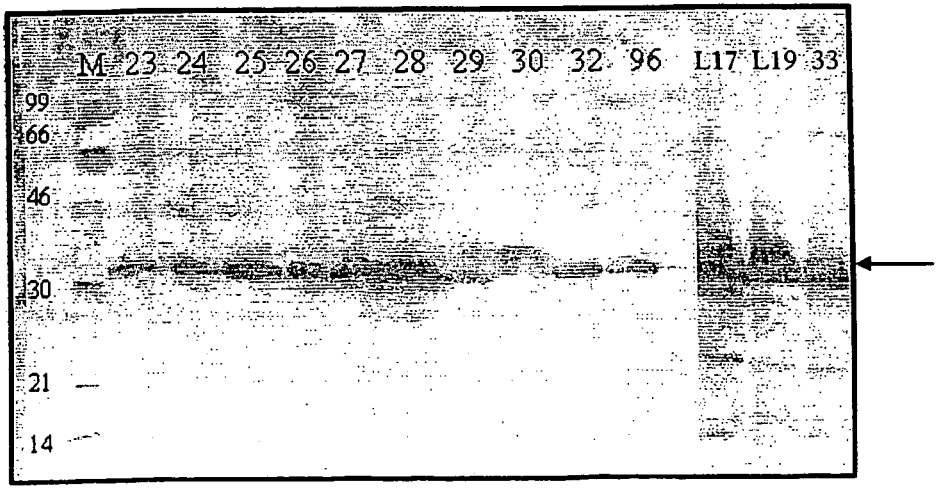

FIG. 20B 225 (27kD)*
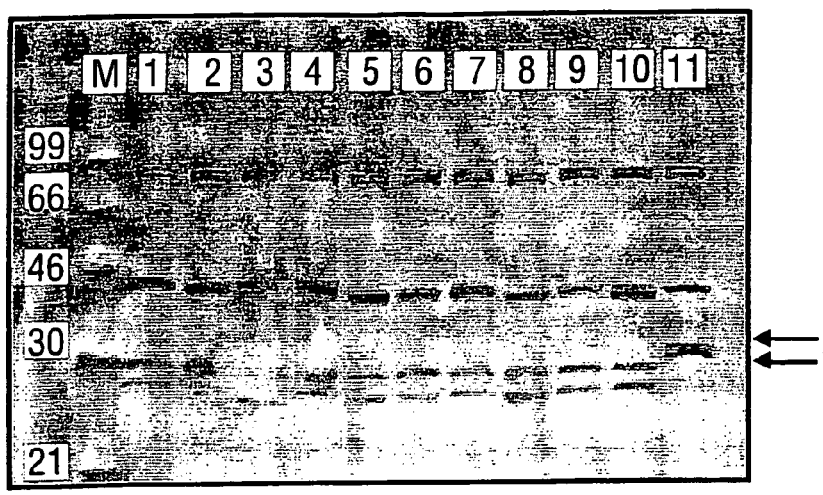
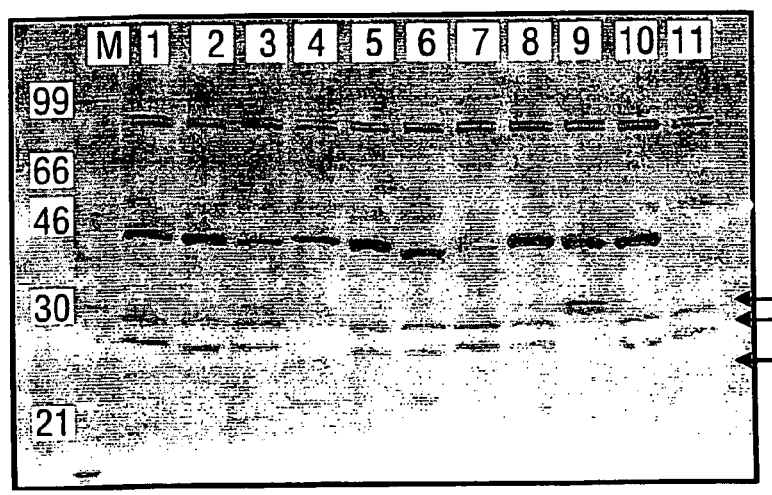
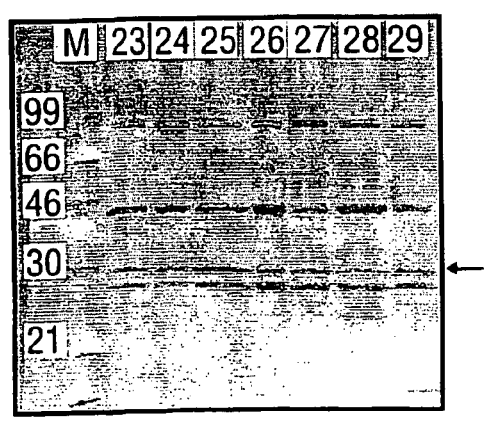
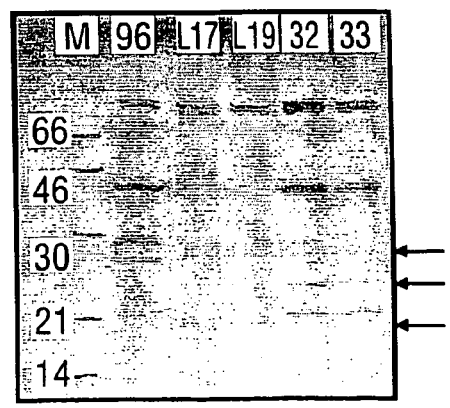

FIG. 20C 235 (23 kD)
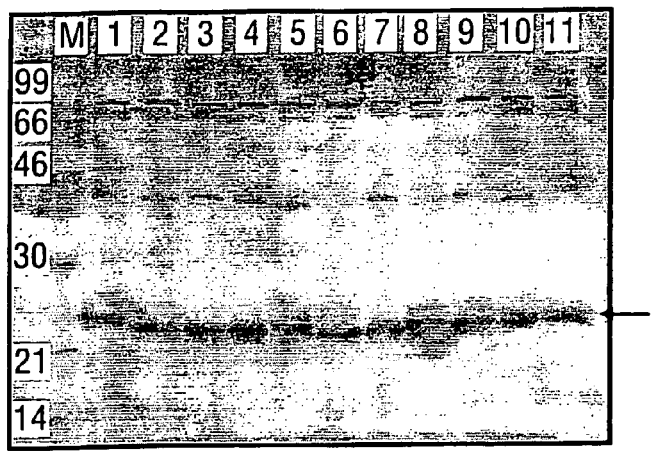
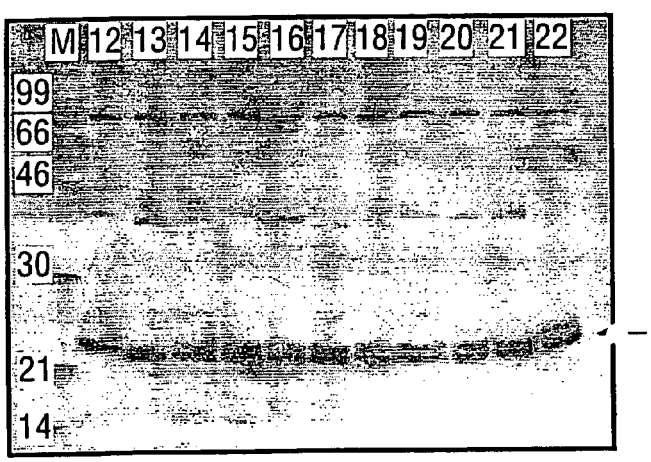
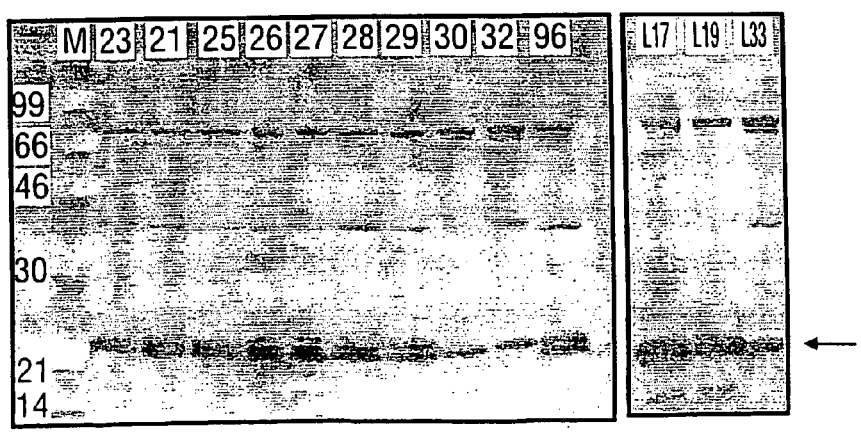

FIG. 20D 519 (35 kD)
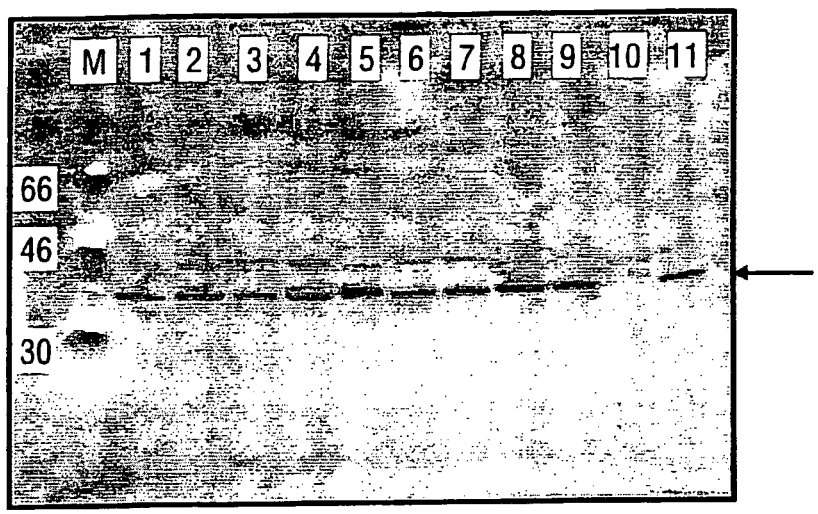
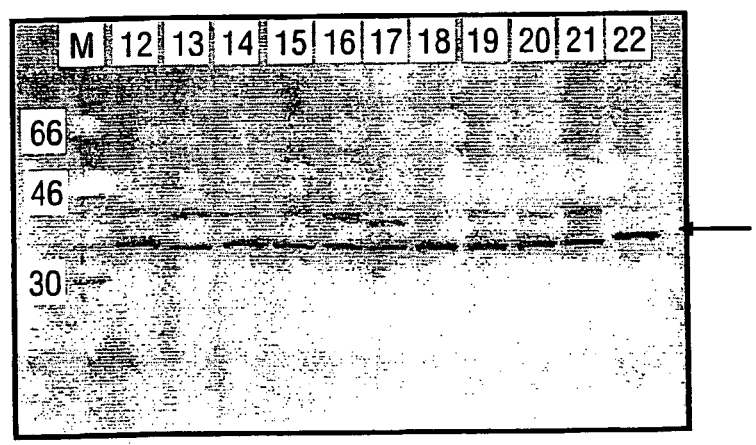
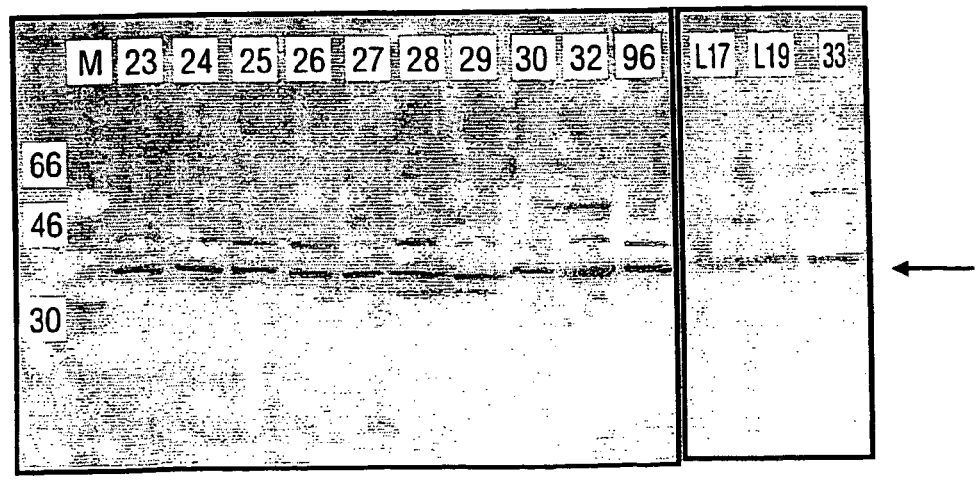

FIG. 20E 919 (48kD)
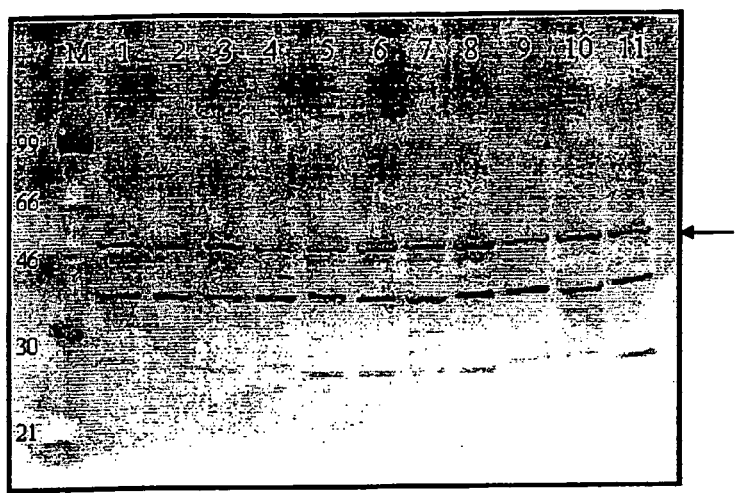
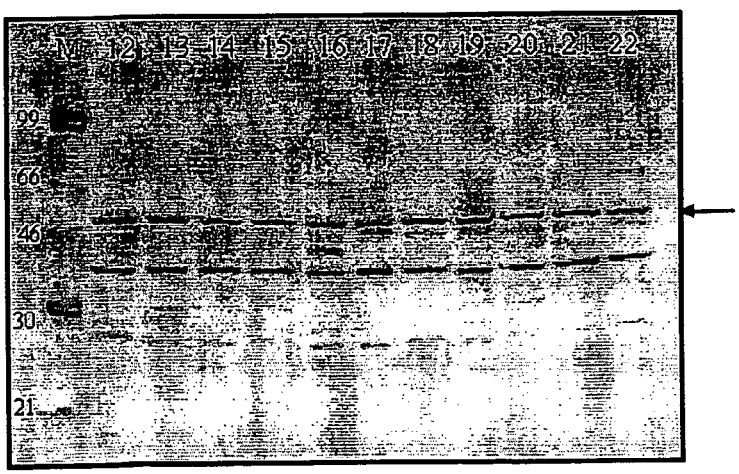
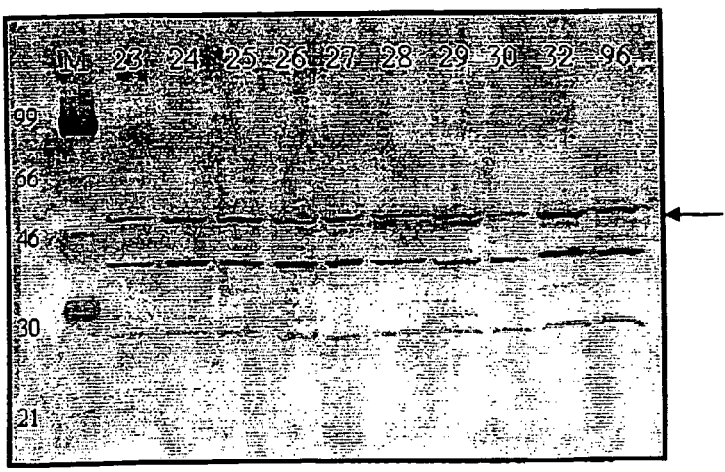

CONSERVED *NEISSERIAL* ANTIGENS

The contents of all documents cited herein are incorporated by reference in their entirety.

FIELD OF THE INVENTION

This invention relates to conserved antigens from the *Neisseria* bacteria.

BACKGROUND ART

*Neisseria meningitidis* and *Neisseria gonorrhoeae* are non-motile, gram negative diplococci that are pathogenic in humans.

Based on the organism's capsular polysaccharide, 12 serogroups of *N. meningitidis* have been identified. Group A is the pathogen most often implicated in epidemic disease in sub-Saharan Africa. Serogroups B and C are responsible for the vast majority of cases in the United States and in most developed countries. Serogroups W135 and Y are responsible for the rest of the cases in the United States and developed countries.

The meningococcal vaccine currently in use is a tetravalent polysaccharide vaccine composed of serogroups A, C, Y and W135. This approach cannot be used for Meningococcus B, however, because the menB capsular polysaccharide is a polymer of $\alpha(2-8)$-linked N-acetyl neuraminic acid that is also present in mammalian tissue. One approach to a menB vaccine uses mixtures of outer membrane proteins (OMPs) To overcome the antigenic variability, multivalent vaccines containing up to nine different porins have been constructed [eg. Poolman (1992) Development of a meningococcal vaccine. *Infect. Agents Dis.* 4:13–28]. Additional proteins to be used in outer membrane vaccines have been the opa and opc proteins, but none of these approaches have been able to overcome the antigenic variability [eg. Ala'Aldeen & Borriello (1996) The meningococcal transferrin-binding proteins 1 and 2 are both surface exposed and generate bactericidal antibodies capable of killing homologous and heterologous strains. *Vaccine* 14(1):49–53].

A large number of Neisserial protein and nucleotide sequences are disclosed in WO99/24578, WO99/36544, WO99/57280 and WO00/22430. The contents of these four applications are incorporated herein by reference. Comprehensive sequence data from strain MC58 is disclosed in Tettelin et al. [*Science* (2000) 287:1809–1815], the contents of which are also incorporated herein by reference.

DESCRIPTION OF THE INVENTION

To ensure maximum cross-strain recognition and reactivity, regions of proteins that are conserved between different Neisserial species, serogroups and strains can be used. The invention therefore provides proteins which comprise stretches of amino acid sequence that are shared across the majority of *Neisseria*, particularly *N. meningitidis* and *N. gonorrhoeae*.

The invention provides a protein comprising a fragment of a Neisserial protein, wherein said fragment consists of n consecutive conserved amino acids, with the proviso that the invention does not include within its scope full-length Neisserial proteins. Depending on the particular protein, n is 7 or more (eg. 8, 10, 12, 14, 16, 18, 20 or more). The fragment preferably comprises an antigenic or immunogenic region of the Neisserial protein.

A "conserved" amino acid is one that is present in a particular Neisserial protein in at least x % of *Neisseria*. The value of x may be 50% or more eg. 66%, 75%, 80%, 90%, 95% or even 100% (ie. the amino acid is found in the protein in question in all *Neisseria*).

In order to determine whether an amino acid is "conserved" in a particular Neisserial protein, it is necessary to compare that amino acid residue in the sequences of the protein in question from a plurality of different *Neisseria* (a "reference population"). The reference population may include a number of different *Neisseria* species (preferably *N. meningitidis* and *N. gonorrhoeae*) or may include a single species. The reference population may include a number of different serogroups of a particular species (such as the A, B, C, W135, X, Y, Z and 29E serogroups of *N. meningitidis*) or a single serogroup. The reference population may also include a number of different strains from a particular serogroup (such as the NG6/88, BZ198, NG3/88, 297-0, BZ147, BZ169, 528, BZ133, NGE31, NGH38, NGH15, BZ232, BZ83, and 44/76 strains of *N. meningitidis* B). A preferred reference population consists of the 5 most common strains of *N. meningitidis* and/or the 5 most common strains of *N. gonorrhoeae*.

The reference population preferably comprises k strains taken from k different branches of a suitable phylogenetic tree, such as those disclosed in (a) Ni et al. (1992) *Epidemiol Infect* 109:227–239 (b) Wolff et al. (1992) *Nucleic Acids Res* 20:4657 (c) Bygraves & Maiden (1992) *J. Gen. Microbiol.* 138:523–531 (d) Caugant et al. (1987) *J. Bacteriol.* 69:2781–2792. Another phylogenetic tree that can be used is shown in FIG. 8 herein, and another in FIG. 9*b*.

It will be appreciated that a particular species, serogroup or strain should only be included in the reference population if it encodes the protein in which the amino acid in question is located. In the case of amino acids within ORF40 described below, for instance, the reference population should not include *N. gonorrhoeae* because this species does not contain ORF40.

For proteins found in both *N. meningitidis* and *N. gonorrhoeae*, therefore, a preferred reference population comprises:

*N. meningitidis* A, strain Z2491
*N. meningitidis* B, strains NG6/88
*N. meningitidis* W, strains A22
*N. gonorrhoeae*, strain Ng F62

These are described in (a) Seiler A. et al. (1996) *Mol. Microbiol.* 19(4):841–856 (b) Maiden et al. (1998) *Proc. Natl. Acad. Sci. USA* 95:3140–3145 (c) Virji et al. (1992) *Mol. Microbiol.* 6:1271–1279 (d) Dempsey et al. (1991) *J. Bacteriol.* 173:5476–5486.

For proteins found only in *N. meningitidis*, however, a preferred reference population comprises:

*N. meningitidis* A, strain Z2491
*N. meningitidis* B, strains NG6/88
*N. meningitidis* W, strains A22

Amino acid sequences of different *Neisseriae* can easily be compared using computers. This will typically involve the alignment of a number of sequences using an algorithm such as CLUSTAL [Thompson et al. (1994) *Nucleic Acids Res* 22:4673–4680; *Trends Biochem Sci* (1998) 23:403–405] or, preferably, PILEUP [part of the GCG Wisconsin package, preferably version 9.0].

Conserved amino acids are readily apparent in a multiple sequence alignment—at the amino acid position in question a majority of the aligned sequences will contain a particular amino acid. Conserved amino acids can be made more visually apparent by using a program such as BOXSHADE

[available, for instance, at the NIH on-line], PRETTYBOX [GCG Wisconsin, version 10] or JALVIEW [available on-line at EBI].

The protein preferably comprises a fragment of one of the proteins disclosed in WO99/24578, WO99/36544, WO99/57280 or WO00/22430, or of one of the 2158 ORFs disclosed in Tettelin et al. [*Science* (2000) 287:1809–1815]. More particularly, it preferably comprises a fragment of one or more of ORF4, ORF40, ORF46, protein 225, protein 235, protein 287, protein 519, protein 726, protein 919 and protein 953 disclosed therein (see examples herein). Typically, the protein of the invention will not comprise a protein sequence explicitly disclosed in WO99/24578, WO99/36544, WO99/57280, WO00/22430, or Tettelin et al.

The invention also provides a protein comprising one of the sequences shown in the Figures.

The proteins of the invention can, of course, be prepared by various means (eg. recombinant expression, native expression, purification from cell culture, chemical synthesis etc.) and in various forms (eg. native, fusions etc.). They are preferably prepared in substantially pure form (ie. substantially free from other Neisserial or host cell proteins)

According to a further aspect, the invention provides antibodies which bind to these proteins. These may be polyclonal or monoclonal and may be produced by any suitable means.

According to a further aspect, the invention provides nucleic acid encoding the proteins of the invention. It should also be appreciated that the invention provides nucleic acid comprising sequences complementary to these (eg. for antisense or probing purposes).

Furthermore, the invention provides nucleic acid which can hybridise to the *N. meningitidis* nucleic acid disclosed in the examples, preferably under "high stringency" conditions (eg. 65° C. in a 0.1×SSC, 0.5% SDS solution).

Nucleic acid according to the invention can, of course, be prepared in many ways (eg. by chemical synthesis, from genomic or cDNA libraries, from the organism itself etc.) and can take various forms (eg. single stranded, double stranded, vectors, probes etc.).

In addition, the term "nucleic acid" includes DNA and RNA, and also their analogues, such as those containing modified backbones, and also peptide nucleic acids (PNA) etc.

According to a further aspect, the invention provides vectors comprising nucleotide sequences of the invention (eg. expression vectors) and host cells transformed with them.

According to a further aspect, the invention provides compositions comprising protein, antibody, and/or nucleic acid according to the invention. These compositions may be suitable as vaccines, for instance, or as diagnostic reagents, or as immunogenic compositions.

The invention also provides nucleic acid, protein, or antibody according to the invention for use as medicaments (eg. as vaccines) or as diagnostic reagents. It also provides the use of nucleic acid, protein, or antibody according to the invention in the manufacture of: (i) a medicament for treating or preventing infection due to Neisserial bacteria; (ii) a diagnostic reagent for detecting the presence of Neisserial bacteria or of antibodies raised against Neisserial bacteria; and/or (iii) a reagent which can raise antibodies against Neisserial bacteria. The use is preferably applicable to all species of *Neisseria*.

Where a Neisserial protein contains more than q % conserved amino acids, the invention provides the use of the Neisserial protein, or a fragment thereof, as a non-strain-specific protein that exhibits cross-reactivity between many species, serogroups and strains. The value of q may be 50%, 60%, 75%, 80%, 90%, 95% or even 100%.

The invention also provides a method of treating a patient, comprising administering to the patient a therapeutically effective amount of nucleic acid, protein, and/or antibody according to the invention.

According to further aspects, the invention provides various processes.

A process for producing proteins of the invention is provided, comprising the step of culturing a host cell according to the invention under conditions which induce protein expression.

A process for producing protein or nucleic acid of the invention is provided, wherein the protein or nucleic acid is synthesised in part or in whole using chemical means.

A process for detecting polynucleotides of the invention is provided, comprising the steps of: (a) contacting a nucleic probe according to the invention with a biological sample under hybridizing conditions to form duplexes; and (b) detecting said duplexes.

A process for detecting proteins of the invention is provided, comprising the steps of: (a) contacting an antibody according to the invention with a biological sample under conditions suitable for the formation of an antibody-antigen complexes; and (b) detecting said complexes.

A summary of standard techniques and procedures which may be employed in order to perform the invention (eg. to utilise the disclosed sequences for vaccination or diagnostic purposes) follows. This summary is not a limitation on the invention but, rather, gives examples that may be used, but are not required.

General

The practice of the present invention will employ, unless otherwise indicated, conventional techniques of molecular biology, microbiology, recombinant DNA, and immunology, which are within the skill of the art. Such techniques are explained fully in the literature eg. Sambrook *Molecular Cloning; A Laboratory Manual, Second Edition* (1989); *DNA Cloning, Volumes I and ii* (D. N Glover ed. 1985); *Oligonucleotide Synthesis* (M. J. Gait ed, 1984); *Nucleic Acid Hybridization* (B. D. Hames & S. J. Higgins eds. 1984); *Transcription and Translation* (B. D. Hames & S. J. Higgins eds. 1984); *Animal Cell Culture* (R. I. Freshney ed. 1986); *Immobilized Cells and Enzymes* (IRL Press, 1986); B. Perbal, *A Practical Guide to Molecular Cloning* (1984); the *Methods in Enzymology series* (Academic Press, Inc.), especially volumes 154 & 155; *Gene Transfer Vectors for Mammalian Cells* (J. H. Miller and M. P. Calos eds. 1987, Cold Spring Harbor Laboratory); Mayer and Walker, eds. (1987), *Immunochemical Methods in Cell and Molecular Biology* (Academic Press, London); Scopes, (1987) *Protein Purification: Principles and Practice*, Second Edition (Springer-Verlag, N.Y.), and *Handbook of Experimental Immunology, Volumes I–IV* (D. M. Weir and C. C. Blackwell eds 1986).

Standard abbreviations for nucleotides and amino acids are used in this specification.

All publications, patents, and patent applications cited herein are incorporated in full by reference. In particular, the contents of international patent applications WO99/24578, WO99/36544, WO99/57280 and WO00/22430 are incorporated herein.

Definitions

A composition containing X is "substantially free of" Y when at least 85% by weight of the total X+Y in the composition is X. Preferably, X comprises at least about 90% by weight of the total of X+Y in the composition, more preferably at least about 95% or even 99% by weight.

The term "comprising" means "including" as well as "consisting" eg. a composition "comprising" X may consist exclusively of X or may include something additional to X, such as X+Y.

The term "heterologous" refers to two biological components that are not found together in nature. The components may be host cells, genes, or regulatory regions, such as promoters. Although the heterologous components are not found together in nature, they can function together, as when a promoter heterologous to a gene is operably linked to the gene. Another example is where a Neisserial sequence is heterologous to a mouse host cell. A further examples would be two epitopes from the same or different proteins which have been assembled in a single protein in an arrangement not found in nature.

An "origin of replication" is a polynucleotide sequence that initiates and regulates replication of polynucleotides, such as an expression vector. The origin of replication behaves as an autonomous unit of polynucleotide replication within a cell, capable of replication under its own control. An origin of replication may be needed for a vector to replicate in a particular host cell. With certain origins of replication, an expression vector can be reproduced at a high copy number in the presence of the appropriate proteins within the cell. Examples of origins are the autonomously replicating sequences, which are effective in yeast; and the viral T-antigen, effective in COS-7 cells.

A "mutant" sequence is defined as DNA, RNA or amino acid sequence differing from but having sequence identity with the native or disclosed sequence. Depending on the particular sequence, the degree of sequence identity between the native or disclosed sequence and the mutant sequence is preferably greater than 50% (eg. 60%, 70%, 80%, 90%, 95%, 99% or more, calculated using the Smith-Waterman algorithm as described above). As used herein, an "allelic variant" of a nucleic acid molecule, or region, for which nucleic acid sequence is provided herein is a nucleic acid molecule, or region, that occurs essentially at the same locus in the genome of another or second isolate, and that, due to natural variation caused by, for example, mutation or recombination, has a similar but not identical nucleic acid sequence. A coding region allelic variant typically encodes a protein having similar activity to that of the protein encoded by the gene to which it is being compared. An allelic variant can also comprise an alteration in the 5' or 3' untranslated regions of the gene, such as in regulatory control regions (eg. see U.S. Pat. No. 5,753,235).

Expression Systems

The Neisserial nucleotide sequences can be expressed in a variety of different expression systems; for example those used with mammalian cells, baculoviruses, plants, bacteria, and yeast.

i. Mammalian Systems

Mammalian expression systems are known in the art. A mammalian promoter is any DNA sequence capable of binding mammalian RNA polymerase and initiating the downstream (3') transcription of a coding sequence (eg. structural gene) into mRNA. A promoter will have a transcription initiating region, which is usually placed proximal to the 5' end of the coding sequence, and a TATA box, usually located 25–30 base pairs (bp) upstream of the transcription initiation site. The TATA box is thought to direct RNA polymerase II to begin RNA synthesis at the correct site. A mammalian promoter will also contain an upstream promoter element, usually located within 100 to 200 bp upstream of the TATA box. An upstream promoter element determines the rate at which transcription is initiated and can act in either orientation [Sambrook et al. (1989) "Expression of Cloned Genes in Mammalian Cells." In *Molecular Cloning: A Laboratory Manual, 2nd ed]*.

Mammalian viral genes are often highly expressed and have a broad host range; therefore sequences encoding mammalian viral genes provide particularly useful promoter sequences. Examples include the SV40 early promoter, mouse mammary tumor virus LTR promoter, adenovirus major late promoter (Ad MLP), and herpes simplex virus promoter. In addition, sequences derived from non-viral genes, such as the murine metallothionein gene, also provide useful promoter sequences. Expression may be either constitutive or regulated (inducible), depending on the promoter can be induced with glucocorticoid in hormone-responsive cells.

The presence of an enhancer element (enhancer), combined with the promoter elements described above, will usually increase expression levels. An enhancer is a regulatory DNA sequence that can stimulate transcription up to 1000-fold when linked to homologous or heterologous promoters, with synthesis beginning at the normal RNA start site. Enhancers are also active when they are placed upstream or downstream from the transcription initiation site, in either normal or flipped orientation, or at a distance of more than 1000 nucleotides from the promoter [Maniatis et al. (1987) *Science* 236:1237; Alberts et al. (1989) *Molecular Biology of the Cell,* 2nd ed.]. Enhancer elements derived from viruses may be particularly useful, because they usually have a broader host range. Examples include the SV40 early gene enhancer [Dijkema et al (1985) *EMBO J.* 4:761] and the enhancer/promoters derived from the long terminal repeat (LTR) of the Rous Sarcoma Virus [Gorman et al. (1982b) *Proc. Natl. Acad. Sci.* 79:6777] and from human cytomegalovirus [Boshart et al. (1985) *Cell* 41:521]. Additionally, some enhancers are regulatable and become active only in the presence of an inducer, such as a hormone or metal ion [Sassone-Corsi and Borelli (1986) *Trends Genet.* 2:215; Maniatis et al. (1987) *Science* 236:1237].

A DNA molecule may be expressed intracellularly in mammalian cells. A promoter sequence may be directly linked with the DNA molecule, in which case the first amino acid at the N-terminus of the recombinant protein will always be a methionine, which is encoded by the ATG start codon. If desired, the N-terminus may be cleaved from the protein by in vitro incubation with cyanogen bromide.

Alternatively, foreign proteins can also be secreted from the cell into the growth media by creating chimeric DNA molecules that encode a fusion protein comprised of a leader sequence fragment that provides for secretion of the foreign protein in mammalian cells. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell. The adenovirus triparite leader is an example of a leader sequence that provides for secretion of a foreign protein in mammalian cells.

Usually, transcription termination and polyadenylation sequences recognized by mammalian cells are regulatory regions located 3' to the translation stop codon and thus, together with the promoter elements, flank the coding sequence. The 3' terminus of the mature mRNA is formed by site-specific post-transcriptional cleavage and polyadenylation [Bimstiel et al. (1985) *Cell* 41:349; Proudfoot and Whitelaw (1988) "Termination and 3' end processing of eukaryotic RNA. In Transcription and splicing (ed. B. D. Hames and D. M. Glover); Proudfoot (1989) *Trends Biochem. Sci.* 14:105]. These sequences direct the transcription of an mRNA which can be translated into the polypeptide encoded by the DNA. Examples of transcription terminator/polyadenylation signals include those derived from SV40 [Sambrook et al (1989) "Expression of cloned genes in cultured mammalian cells." In *Molecular Cloning: A Laboratory Manual*].

Usually, the above described components, comprising a promoter, polyadenylation signal, and transcription termination sequence are put together into expression constructs. Enhancers, introns with functional splice donor and acceptor sites, and leader sequences may also be included in an expression construct, if desired. Expression constructs are often maintained in a replicon, such as an extrachromosomal element (eg. plasmids) capable of stable maintenance in a host, such as mammalian cells or bacteria. Mammalian replication systems include those derived from animal viruses, which require trans-acting factors to replicate. For example, plasmids containing the replication systems of papovaviruses, such as SV40 [Gluzman (1981) *Cell* 23:175] or polyomavirus, replicate to extremely high copy number in the presence of the appropriate viral T antigen. Additional examples of mammalian replicons include those derived from bovine papillomavirus and Epstein-Barr virus. Additionally, the replicon may have two replication systems, thus allowing it to be maintained, for example, in mammalian cells for expression and in a prokaryotic host for cloning and amplification. Examples of such mammalian-bacteria shuttle vectors include pMT2 [Kaufman et al. (1989) *Mol. Cell. Biol.* 9:946] and pHEBO [Shimizu et al. (1986) *Mol. Cell. Biol.* 6:1074].

The transformation procedure used depends upon the host to be transformed. Methods for introduction of heterologous polynucleotides into mammalian cells are known in the art and include dextran-mediated transfection, calcium phosphate precipitation, polybrene mediated transfection, protoplast fusion, electroporation, encapsulation of the polynucleotide(s) in liposomes, and direct microinjection of the DNA into nuclei.

Mammalian cell lines available as hosts for expression are known in the art and include many immortalized cell lines available from the American Type Culture Collection (ATCC), including but not limited to, Chinese hamster ovary (CHO) cells, HeLa cells, baby hamster kidney (BHK) cells, monkey kidney cells (COS), human hepatocellular carcinoma cells (eg. Hep G2), and a number of other cell lines.

ii. Baculovirus Systems

The polynucleotide encoding the protein can also be inserted into a suitable insect expression vector, and is operably linked to the control elements within that vector. Vector construction employs techniques which are known in the art. Generally, the components of the expression system include a transfer vector, usually a bacterial plasmid, which contains both a fragment of the baculovirus genome, and a convenient restriction site for insertion of the heterologous gene or genes to be expressed; a wild type baculovirus with a sequence homologous to the baculovirus-specific fragment in the transfer vector (this allows for the homologous recombination of the heterologous gene in to the baculovirus genome); and appropriate insect host cells and growth media.

After inserting the DNA sequence encoding the protein into the transfer vector, the vector and the wild type viral genome are transfected into an insect host cell where the vector and viral genome are allowed to recombine. The packaged recombinant virus is expressed and recombinant plaques are identified and purified. Materials and methods for baculovirus/insect cell expression systems are commercially available in kit form from, inter alia, Invitrogen, San Diego Calif. ("MaxBac" kit). These techniques are generally known to those skilled in the art and fully described in Summers and Smith, *Texas Agricultural Experiment Station Bulletin No.* 1555 (1987) (hereinafter "Summers and Smith").

Prior to inserting the DNA sequence encoding the protein into the baculovirus genome, the above described components, comprising a promoter, leader (if desired), coding sequence of interest, and transcription termination sequence, are usually assembled into an intermediate transplacement construct (transfer vector). This construct may contain a single gene and operably linked regulatory elements; multiple genes, each with its owned set of operably linked regulatory elements; or multiple genes, regulated by the same set of regulatory elements. Intermediate transplacement constructs are often maintained in a replicon, such as an extrachromosomal element (eg. plasmids) capable of stable maintenance in a host, such as a bacterium. The replicon will have a replication system, thus allowing it to be maintained in a suitable host for cloning and amplification.

Currently, the most commonly used transfer vector for introducing foreign genes into AcNPV is pAc373. Many other vectors, known to those of skill in the art, have also been designed. These include, for example, pVL985 (which alters the polyhedrin start codon from ATG to ATT, and which introduces a BamHI cloning site 32 basepairs downstream from the ATT; see Luckow and Summers, *Virology* (1989) 17:31.

The plasmid usually also contains the polyhedrin polyadenylation signal (Miller et al. (1988) *Ann. Rev. Microbiol.*, 42:177) and a prokaryotic ampicillin-resistance (amp) gene and origin of replication for selection and propagation in *E. coli*.

Baculovirus transfer vectors usually contain a baculovirus promoter. A baculovirus promoter is any DNA sequence capable of binding a baculovirus RNA polymerase and initiating the downstream (5' to 3') transcription of a coding sequence (eg. structural gene) into mRNA. A promoter will have a transcription initiation region which is usually placed proximal to the 5' end of the coding sequence. This transcription initiation region usually includes an RNA polymerase binding site and a transcription initiation site. A baculovirus transfer vector may also have a second domain called an enhancer, which, if present, is usually distal to the structural gene. Expression may be either regulated or constitutive.

Structural genes, abundantly transcribed at late times in a viral infection cycle, provide particularly useful promoter sequences. Examples include sequences derived from the gene encoding the viral polyhedron protein, Friesen et al., (1986) "The Regulation of Baculovirus Gene Expression," in: *The Molecular Biology of Baculoviruses* (ed. Walter Doerfler); EPO Publ. Nos. 127 839 and 155 476; and the gene encoding the p10 protein, Vlak et al., (1988), *J. Gen. Virol.* 69:765.

DNA encoding suitable signal sequences can be derived from genes for secreted insect or baculovirus proteins, such as the baculovirus polyhedrin gene (Carbonell et al. (1988) *Gene*, 73:409). Alternatively, since the signals for mammalian cell posttranslational modifications (such as signal peptide cleavage, proteolytic cleavage, and phosphorylation) appear to be recognized by insect cells, and the signals required for secretion and nuclear accumulation also appear to be conserved between the invertebrate cells and vertebrate cells, leaders of non-insect origin, such as those derived from genes encoding human α-interferon, Maeda et al., (1985), *Nature* 315:592; human gastrin-releasing peptide, Lebacq-Verheyden et al., (1988), *Molec. Cell. Biol.* 8:3129; human IL-2, Smith et al., (1985) *Proc. Nat'l Acad. Sci. USA*, 82:8404; mouse IL-3, (Miyajima et al., (1987) *Gene* 58:273; and human glucocerebrosidase, Martin et al. (1988) *DNA*, 7:99, can also be used to provide for secretion in insects.

A recombinant polypeptide or polyprotein may be expressed intracellularly or, if it is expressed with the proper regulatory sequences, it can be secreted. Good intracellular expression of nonfused foreign proteins usually requires heterologous genes that ideally have a short leader sequence containing suitable translation initiation signals preceding an ATG start signal. If desired, methionine at the N-terminus may be cleaved from the mature protein by in vitro incubation with cyanogen bromide.

Alternatively, recombinant polyproteins or proteins which are not naturally secreted can be secreted from the insect cell by creating chimeric DNA molecules that encode a fusion protein comprised of a leader sequence fragment that provides for secretion of the foreign protein in insects. The leader sequence fragment usually encodes a signal peptide comprised of hydrophobic amino acids which direct the translocation of the protein into the endoplasmic reticulum.

After insertion of the DNA sequence and/or the gene encoding the expression product precursor of the protein, an insect cell host is co-transformed with the heterologous DNA of the transfer vector and the genomic DNA of wild type baculovirus—usually by co-transfection. The promoter and transcription termination sequence of the construct will usually comprise a 2–5 kb section of the baculovirus genome. Methods for introducing heterologous DNA into the desired site in the baculovirus virus are known in the art. (See Summers and Smith supra Ju et al. (1987); Smith et al., *Mol. Cell. Biol* (1983) 3:2156; and Luckow and Summers (1989)). For example, the insertion can be into a gene such as the polyhedrin gene, by homologous double crossover recombination; insertion can also be into a restriction enzyme site engineered into the desired baculovirus gene. Miller et al., (1989), *Bioessays* 4:91. The DNA sequence, when cloned in place of the polyhedrin gene in the expression vector, is flanked both 5' and 3' by polyhedrin-specific sequences and is positioned downstream of the polyhedrin promoter.

The newly formed baculovirus expression vector is subsequently packaged into an infectious recombinant baculovirus. Homologous recombination occurs at low frequency (between about 1% and about 5%); thus, the majority of the virus produced after cotransfection is still wild-type virus. Therefore, a method is necessary to identify recombinant viruses. An advantage of the expression system is a visual screen allowing recombinant viruses to be distinguished. The polyhedrin protein, which is produced by the native virus, is produced at very high levels in the nuclei of infected cells at late times after viral infection. Accumulated polyhedrin protein forms occlusion bodies that also contain embedded particles. These occlusion bodies, up to 15 μm in size, are highly refractile, giving them a bright shiny appearance that is readily visualized under the light microscope. Cells infected with recombinant viruses lack occlusion bodies. To distinguish recombinant virus from wild-type virus, the transfection supernatant is plaqued onto a monolayer of insect cells by techniques known to those skilled in the art. Namely, the plaques are screened under the light microscope for the presence (indicative of wild-type virus) or absence (indicative of recombinant virus) of occlusion bodies. "Current Protocols in Microbiology" Vol. 2 (Ausubel et al. eds) at 16.8 (Supp. 10, 1990); Summers and Smith, supra; Miller et al. (1989).

Recombinant baculovirus expression vectors have been developed for infection into several insect cells. For example, recombinant baculoviruses have been developed for, inter alia: *Aedes aegypti*, *Autographa californica*, *Bombyx mori*, *Drosophila melanogaster*, *Spodoptero frugiperda*, and *Trichoplusia ni* (WO 89/046699; Carbonell et al., (1985) *J. Virol.* 56:153; Wright (1986) *Nature* 321:718; Smith et al., (1983) *Mol. Cell. Biol.* 3:2156; and see generally, Fraser, et al. (1989) *In Vitro Cell. Dev. Biol.* 25:225).

Cells and cell culture media are commercially available for both direct and fusion expression of heterologous polypeptides in a baculovirus/expression system; cell culture technology is generally known to those skilled in the art. See, eg. Summers and Smith supra.

The modified insect cells may then be grown in an appropriate nutrient medium, which allows for stable maintenance of the plasmid(s) present in the modified insect host. Where the expression product gene is under inducible control, the host may be grown to high density, and expression induced. Alternatively, where expression is constitutive, the product will be continuously expressed into the medium and the nutrient medium must be continuously circulated, while removing the product of interest and augmenting depleted nutrients. The product may be purified by such techniques as chromatography, eg. HPLC, affinity chromatography, ion exchange chromatography, etc.; electrophoresis; density gradient centrifugation; solvent extraction, or the like. As appropriate, the product may be further purified, as required, so as to remove substantially any insect proteins which are also secreted in the medium or result from lysis of insect cells, so as to provide a product which is at least substantially free of host debris, eg. proteins, lipids and polysaccharides.

In order to obtain protein expression, recombinant host cells derived from the transformants are incubated under conditions which allow expression of the recombinant protein encoding sequence. These conditions will vary, dependent upon the host cell selected. However, the conditions are readily ascertainable to those of ordinary skill in the art, based upon what is known in the art.

iii. Plant Systems

There are many plant cell culture and whole plant genetic expression systems known in the art. Exemplary plant cellular genetic expression systems include those described in patents, such as: U.S. Pat. No. 5,693,506; U.S. Pat. No. 5,659,122; and U.S. Pat. No. 5,608,143. Additional examples of genetic expression in plant cell culture has been described by Zenk, *Phytochemistry* 30:3861–3863 (1991). Descriptions of plant protein signal peptides may be found in addition to the references described above in Vaulcombe et al., *Mol. Gen. Genet.* 209:33–40 (1987); Chandler et al., *Plant Molecular Biology* 3:407–418 (1984); Rogers, *J. Biol. Chem.* 260:3731–3738 (1985); Rothstein et al., *Gene* 55:353–356 (1987); Whittier et al., Nucleic Acids Research 15:2515–2535 (1987); Wirsel et al., *Molecular Microbiology* 3:3–14 (1989); Yu et al., *Gene* 122:247–253 (1992). A description of the regulation of plant gene expression by the phytohormone, gibberellic acid and secreted enzymes induced by gibberellic acid can be found in R. L. Jones and J. MacMillin, Gibberellins: in: *Advanced Plant Physiology*, Malcolm B. Wilkins, ed., 1984 Pitman Publishing Limited, London, pp. 21–52. References that describe other metabolically-regulated genes: Sheen, *Plant Cell*, 2:1027–1038 (1990); Maas et al., *EMBO J.* 9:3447–3452 (1990); Benkel and Hickey, *Proc. Natl. Acad. Sci.* 84:1337–1339 (1987)

Typically, using techniques known in the art, a desired polynucleotide sequence is inserted into an expression cassette comprising genetic regulatory elements designed for operation in plants. The expression cassette is inserted into a desired expression vector with companion sequences upstream and downstream from the expression cassette suitable for expression in a plant host. The companion sequences will be of plasmid or viral origin and provide necessary characteristics to the vector to permit the vectors to move DNA from an original cloning host, such as bacteria, to the desired plant host. The basic bacterial/plant vector construct will preferably provide a broad host range prokaryote replication origin; a prokaryote selectable marker; and, for *Agrobacterium* transformations, T DNA sequences for *Agrobacterium*-mediated transfer to plant chromosomes. Where the heterologous gene is not readily amenable to detection, the construct will preferably also have a selectable marker gene suitable for determining if a plant cell has been transformed. A general review of suitable markers, for example for the members of the grass family, is found in Wilmink and Dons, 1993, *Plant Mol. Biol. Reptr*, 11(2):165–185.

Sequences suitable for permitting integration of the heterologous sequence into the plant genome are also recommended. These might include transposon sequences and the like for homologous recombination as well as Ti sequences which permit random insertion of a heterologous expression cassette into a plant genome. Suitable prokaryote selectable markers include resistance toward antibiotics such as ampicillin or tetracycline. Other DNA sequences encoding additional functions may also be present in the vector, as is known in the art.

The nucleic acid molecules of the subject invention may be included into an expression cassette for expression of the protein(s) of interest. Usually, there will be only one expression cassette, although two or more are feasible. The recombinant expression cassette will contain in addition to the heterologous protein encoding sequence the following elements, a promoter region, plant 5' untranslated sequences, initiation codon depending upon whether or not the structural gene comes equipped with one, and a transcription and translation termination sequence. Unique restriction enzyme sites at the 5' and 3' ends of the cassette allow for easy insertion into a pre-existing vector.

A heterologous coding sequence may be for any protein relating to the present invention. The sequence encoding the protein of interest will encode a signal peptide which allows processing and translocation of the protein, as appropriate, and will usually lack any sequence which might result in the binding of the desired protein of the invention to a membrane. Since, for the most part, the transcriptional initiation region will be for a gene which is expressed and translocated during germination, by employing the signal peptide which provides for translocation, one may also provide for translocation of the protein of interest. In this way, the protein(s) of interest will be translocated from the cells in which they are expressed and may be efficiently harvested. Typically secretion in seeds are across the aleurone or scutellar epithelium layer into the endosperm of the seed. While it is not required that the protein be secreted from the cells in which the protein is produced, this facilitates the isolation and purification of the recombinant protein.

Since the ultimate expression of the desired gene product will be in a eucaryotic cell it is desirable to determine whether any portion of the cloned gene contains sequences which will be processed out as introns by the host's splicosome machinery. If so, site-directed mutagenesis of the "intron" region may be conducted to prevent losing a portion of the genetic message as a false intron code, Reed and Maniatis, *Cell* 41:95–105, 1985.

The vector can be microinjected directly into plant cells by use of micropipettes to mechanically transfer the recombinant DNA. Crossway, *Mol. Gen. Genet,* 202:179–185, 1985. The genetic material may also be transferred into the plant cell by using polyethylene glycol, Krens, et al., *Nature,* 296, 72–74, 1982. Another method of introduction of nucleic acid segments is high velocity ballistic penetration by small particles with the nucleic acid either within the matrix of small beads or particles, or on the surface, Klein, et al., *Nature,* 327, 70–73, 1987 and Knudsen and Muller, 1991, *Planta,* 185:330–336 teaching particle bombardment of barley endosperm to create transgenic barley. Yet another method of introduction would be fusion of protoplasts with other entities, either minicells, cells, lysosomes or other fusible lipid-surfaced bodies, Fraley, et al., *Proc. Natl. Acad. Sci. USA,* 79, 1859–1863, 1982.

The vector may also be introduced into the plant cells by electroporation. (Fromm et al., *Proc. Natl Acad. Sci. USA* 82:5824, 1985). In this technique, plant protoplasts are electroporated in the presence of plasmids containing the gene construct. Electrical impulses of high field strength reversibly permeabilize biomembranes allowing the introduction of the plasmids. Electroporated plant protoplasts reform the cell wall, divide, and form plant callus.

All plants from which protoplasts can be isolated and cultured to give whole regenerated plants can be transformed by the present invention so that whole plants are recovered which contain the transferred gene. It is known that practically all plants can be regenerated from cultured cells or tissues, including but not limited to all major species of sugarcane, sugar beet, cotton, fruit and other trees, legumes and vegetables. Some suitable plants include, for example, species from the genera *Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersion, Nicotiana, Solanum, Petunia, Digitalis, Majorana, Cichorium, Helianthus, Lactuca, Bromus, Asparagus, Antirrhinum, Hererocallis, Nemesia, Pelargonium, Panicum, Pennisetum, Ranunculus, Senecio, Salpiglossis, Cucumis, Browaalia, Glycine, Lolium, Zea, Triticum, Sorghum,* and *Datura.*

Means for regeneration vary from species to species of plants, but generally a suspension of transformed protoplasts containing copies of the heterologous gene is first provided. Callus tissue is formed and shoots may be induced from callus and subsequently rooted. Alternatively, embryo formation can be induced from the protoplast suspension. These embryos germinate as natural embryos to form plants. The culture media will generally contain various amino acids and hormones, such as auxin and cytokinins. It is also advantageous to add glutamic acid and proline to the medium, especially for such species as corn and alfalfa. Shoots and roots normally develop simultaneously. Efficient regeneration will depend on the medium, on the genotype, and on the history of the culture. If these three variables are controlled, then regeneration is fully reproducible and repeatable.

In some plant cell culture systems, the desired protein of the invention may be excreted or alternatively, the protein may be extracted from the whole plant. Where the desired protein of the invention is secreted into the medium, it may be collected. Alternatively, the embryos and embryoless-half seeds or other plant tissue may be mechanically disrupted to release any secreted protein between cells and tissues. The mixture may be suspended in a buffer solution to retrieve soluble proteins. Conventional protein isolation and purification methods will be then used to purify the recombinant protein. Parameters of time, temperature pH, oxygen, and volumes will be adjusted through routine methods to optimize expression and recovery of heterologous protein.

iv. Bacterial Systems

Bacterial expression techniques are known in the art. A bacterial promoter is any DNA sequence capable of binding bacterial RNA polymerase and initiating the downstream (3') transcription of a coding sequence (eg. structural gene) into mRNA. A promoter will have a transcription initiation region which is usually placed proximal to the 5' end of the coding sequence. This transcription initiation region usually includes an RNA polymerase binding site and a transcription initiation site. A bacterial promoter may also have a second domain called an operator, that may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence. An example of a gene activator protein is the catabolite activator protein (CAP), which helps initiate transcription of the lac operon in *Escherichia coli* (*E. coli*) [Raibaud et al. (1984) *Annu. Rev. Genet.* 18:173]. Regulated expression may therefore be either positive or negative, thereby either enhancing or reducing transcription.

Sequences encoding metabolic pathway enzymes provide particularly useful promoter sequences. Examples include promoter sequences derived from sugar metabolizing enzymes, such as galactose, lactose (lac) [Chang et al. (1977) *Nature* 198:1056], and maltose. Additional examples include promoter sequences derived from biosynthetic enzymes such as tryptophan (trp) [Goeddel et al. (1980) *Nuc. Acids Res.* 8:4057; Yelverton et al. (1981) *Nucl. Acids Res.* 9:731; U.S. Pat. No. 4,738,921; EP-A-0036776 and EP-A-0121775). The g-laotamase (bla) promoter system [Weissmann (1981) "The cloning of interferon and other mistakes." In *Interferon* 3 (ed. I. Gresser)], bacteriophage lambda PL [Shimatake et al. (1981) *Nature* 292:128] and T5 [U.S. Pat. No. 4,689,406] promoter systems also provide useful promoter sequences.

In addition, synthetic promoters which do not occur in nature also function as bacterial promoters. For example, transcription activation sequences of one bacterial or bacteriophage promoter may be joined with the operon sequences of another bacterial or bacteriophage promoter, creating a synthetic hybrid promoter [U.S. Pat. No. 4,551,433]. For example, the tac promoter is a hybrid trp-lac promoter comprised of both trp promoter and lac operon sequences that is regulated by the lac repressor [Amann et al. (1983) *Gene* 25:167; de Boer et al. (1983) *Proc. Natl. Acad. Sci.* 80:21]. Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system [Studier et al. (1986) *J. Mol. Biol.* 189:113; Tabor et al. (1985) *Proc Natl. Acad. Sci.* 82:1074]. In addition, a hybrid promoter can also be comprised of a bacteriophage promoter and an *E. coli* operator region (EPO-A-0 267 851).

In addition to a functioning promoter sequence, an efficient ribosome binding site is also useful for the expression of foreign genes in prokaryotes. In *E. coli*, the ribosome binding site is called the Shine-Dalgarno (SD) sequence and includes an initiation codon (ATG) and a sequence 3–9 nucleotides in length located 3–11 nucleotides upstream of the initiation codon [Shine et al. (1975) *Nature* 254:34]. The SD sequence is thought to promote binding of mRNA to the ribosome by the pairing of bases between the SD sequence and the 3' and of *E. coli* 16S rRNA [Steitz et al. (1979) "Genetic signals and nucleotide sequences in messenger RNA." In *Biological Regulation and Development: Gene Expression* (ed. R. F. Goldberger)]. To express eukaryotic genes and prokaryotic genes with weak ribosome-binding site [Sambrook et al. (1989) "Expression of cloned genes in *Escherichia coli*." In *Molecular Cloning: A Laboratory Manual*].

A DNA molecule may be expressed intracellularly. A promoter sequence may be directly linked with the DNA molecule, in which case the first amino acid at the N-terminus will always be a methionine, which is encoded by the ATG start codon. If desired, methionine at the N-terminus may be cleaved from the protein by in vitro incubation with cyanogen bromide or by either in vivo on in vitro incubation with a bacterial methionine N-terminal peptidase (EPO-A-0 219 237).

Fusion proteins provide an alternative to direct expression. Usually, a DNA sequence encoding the N-terminal portion of an endogenous bacterial protein, or other stable protein, is fused to the 5' end of heterologous coding sequences. Upon expression, this construct will provide a fusion of the two amino acid sequences. For example, the bacteriophage lambda cell gene can be linked at the 5' terminus of a foreign gene and expressed in bacteria. The resulting fusion protein preferably retains a site for a processing enzyme (factor Xa) to cleave the bacteriophage protein from the foreign gene [Nagai et al. (1984) *Nature* 309:810]. Fusion proteins can also be made with sequences from the lacZ [Jia et al. (1987) *Gene* 60:197], trpE [Allen et al. (1987) J. Biotechnol. 5:93; Makoff et al. (1989) *J. Gen. Microbiol.* 135:11], and *Chey* [EP-A-0 324 647] genes. The DNA sequence at the junction of the two amino acid sequences may or may not encode a cleavable site. Another example is a ubiquitin fusion protein. Such a fusion protein is made with the ubiquitin region that preferably retains a site for a processing enzyme (eg. ubiquitin specific processing-protease) to cleave the ubiquitin from the foreign protein. Through this method, native foreign protein can be isolated [Miller et al. (1989) *Bio/Technology* 7:698].

Alternatively, foreign proteins can also be secreted from the cell by creating chimeric DNA molecules that encode a fusion protein comprised of a signal peptide sequence fragment that provides for secretion of the foreign protein in bacteria [U.S. Pat. No. 4,336,336]. The signal sequence fragment usually encodes a signal peptide comprised of hydrophobic amino acids which direct the secretion of the protein from the cell. The protein is either secreted into the growth media (gram-positive bacteria) or into the periplasmic space, located between the inner and outer membrane of the cell (gram-negative bacteria). Preferably there are processing sites, which can be cleaved either in vivo or in vitro encoded between the signal peptide fragment and the foreign gene.

DNA encoding suitable signal sequences can be derived from genes for secreted bacterial proteins, such as the *E. coli* outer membrane protein gene (ompA) [Masui et al. (1983), in: *Experimental Manipulation of Gene Expression*; Ghrayeb et al. (1984) *EMBO J.* 3:2437] and the *E. coli* alkaline phosphatase signal sequence (phoA) [Oka et al. (1985) *Proc. Natl. Acad. Sci.* 82:7212]. As an additional example, the signal sequence of the alpha-amylase gene from various *Bacillus* strains can be used to secrete heterologous proteins from *B. subtilis* [Palva et al. (1982) *Proc. Natl. Acad. Sci. USA* 79:5582; EP-A-0 244 042].

Usually, transcription termination sequences recognized by bacteria are regulatory regions located 3' to the translation stop codon, and thus together with the promoter flank the coding sequence. These sequences direct the transcription of an mRNA which can be translated into the polypeptide encoded by the DNA. Transcription termination sequences frequently include DNA sequences of about 50 nucleotides capable of forming stem loop structures that aid in terminating transcription. Examples include transcription termination sequences derived from genes with strong promoters, such as the trp gene in *E. coli* as well as other biosynthetic genes.

Usually, the above described components, comprising a promoter, signal sequence (if desired), coding sequence of interest, and transcription termination sequence, are put together into expression constructs. Expression constructs are often maintained in a replicon, such as an extrachromosomal element (eg. plasmids) capable of stable maintenance in a host, such as bacteria. The replicon will have a replication system, thus allowing it to be maintained in a prokaryotic host either for expression or for cloning and amplification. In addition, a replicon may be either a high or low copy number plasmid. A high copy number plasmid will generally have a copy number ranging from about 5 to about 200, and usually about 10 to about 150. A host containing a high copy number plasmid will preferably contain at least about 10, and more preferably at least about 20 plasmids. Either a high or low copy number vector may be selected, depending upon the effect of the vector and the foreign protein on the host.

Alternatively, the expression constructs can be integrated into the bacterial genome with an integrating vector. Integrating vectors usually contain at least one sequence homologous to the bacterial chromosome that allows the vector to integrate. Integrations appear to result from recombinations between homologous DNA in the vector and the bacterial chromosome. For example, integrating vectors constructed with DNA from various *Bacillus* strains integrate into the *Bacillus* chromosome (EP-A-0 127 328). Integrating vectors may also be comprised of bacteriophage or transposon sequences.

Usually, extrachromosomal and integrating expression constructs may contain selectable markers to allow for the selection of bacterial strains that have been transformed. Selectable markers can be expressed in the bacterial host and may include genes which render bacteria resistant to drugs such as ampicillin, chloramphenicol, erythromycin, kanamycin (neomycin), and tetracycline [Davies et al. (1978) *Annu. Rev. Microbiol.* 32:469]. Selectable markers may also include biosynthetic genes, such as those in the histidine, tryptophan, and leucine biosynthetic pathways.

Alternatively, some of the above described components can be put together in transformation vectors. Transformation vectors are usually comprised of a selectable market that is either maintained in a replicon or developed into an integrating vector, as described above.

Expression and transformation vectors, either extra-chromosomal replicons or integrating vectors, have been developed for transformation into many bacteria. For example, expression vectors have been developed for, inter alia, the following bacteria: *Bacillus subtilis* [Palva et al. (1982) *Proc. Natl. Acad. Sci. USA* 79:5582; EP-A-0 036 259 and EP-A-0 063 953; WO 84/04541], *Escherichia coli* [Shimatake et al. (1981) *Nature* 292:128; Amann et al. (1985) *Gene* 40:183; Studier et al. (1986) *J. Mol. Biol.* 189:113; EP-A-0 036 776, EP-A-0 136 829 and EP-A-0 136 907], *Streptococcus cremoris* [Powell et al. (1988) *Appl. Environ. Microbiol.* 54:655]; *Streptococcus lividans* [Powell et al. (1988) *Appl. Environ. Microbiol.* 54:655], *Streptomyces lividans* [U.S. Pat. No. 4,745,056].

Methods of introducing exogenous DNA into bacterial hosts are well-known in the art, and usually include either the transformation of bacteria treated with $CaCl_2$ or other agents, such as divalent cations and DMSO. DNA can also be introduced into bacterial cells by electroporation. Transformation procedures usually vary with the bacterial species to be transformed. See eg. [Masson et al. (1989) *FEMS Microbiol. Lett.* 60:273; Palva et al. (1982) *Proc. Natl. Acad. Sci. USA* 79:5582; EP-A-0 036 259 and EP-A-0 063 953; WO 84/04541, *Bacillus*], [Miller et al. (1988) *Proc. Natl. Acad. Sci* 85:856; Wang et al. (1990) *J. Bacterial.* 172:949, *Campylobacter*], [Cohen et al. (1973) *Proc. Natl. Acad. Sci.* 69:2110; Dower et al. (1988) *Nucleic Acids Res.* 16:6127; Kushner (1978) "An improved method for transformation of *Escherichia coli* with ColE1-derived plasmids. In *Genetic Engineering: Proceedings of the International Symposium on Genetic Engineering* (eds. H. W. Boyer and S. Nicosia); Mandel et al. (1970) *J. Mol. Biol.* 53:159; Taketo (1988) *Biochim. Biophys. Acta* 949:318; *Escherichia*], [Chassy et al. (1987) *FEMS Microbiol. Lett.* 44:173 *Lactobacillus*]; [Fiedler et al. (1988) *Anal. Biochem* 170:38, *Pseudomonas*]; [Augustin et al. (1990) *FEMS Microbiol. Lett.* 66:203, *Staphylococcus*], [Barany et al. (1980) *J. Bacteriol.* 144:698; Harlander (1987) "Transformation of *Streptococcus lactis* by electroporation, in: *Streptococcal Genetics* (ed. J. Ferretti and R. Curtiss III); Perry et al. (1981) *Infect. Immun.* 32:1295; Powell et al. (1988) *Appl. Environ. Microbiol.* 54:655; Somkuti et al. (1987) *Proc. 4th Evr. Cong. Biotechnology* 1:412, *Streptococcus*].

v. Yeast Expression

Yeast expression systems are also known to one of ordinary skill in the art. A yeast promoter is any DNA sequence capable of binding yeast RNA polymerase and initiating the downstream (3') transcription of a coding sequence (eg. structural gene) into mRNA. A promoter will have a transcription initiation region which is usually placed proximal to the 5' end of the coding sequence. This transcription initiation region usually includes an RNA polymerase binding site (the "TATA Box") and a transcription initiation site. A yeast promoter may also have a second domain called an upstream activator sequence (UAS), which, if present, is usually distal to the structural gene. The UAS permits regulated (inducible) expression. Constitutive expression occurs in the absence of a UAS. Regulated expression may be either positive or negative, thereby either enhancing or reducing transcription.

Yeast is a fermenting organism with an active metabolic pathway, therefore sequences encoding enzymes in the metabolic pathway provide particularly useful promoter sequences. Examples include alcohol dehydrogenase (ADH) (EP-A-0 284 044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (EPO-A-0 329 203). The yeast PHO5 gene, encoding acid phosphatase, also provides useful promoter sequences [Myanohara et al. (1983) *Proc. Natl. Acad. Sci. USA* 80:1].

In addition, synthetic promoters which do not occur in nature also function as yeast promoters. For example, UAS sequences of one yeast promoter may be joined with the transcription activation region of another yeast promoter, creating a synthetic hybrid promoter. Examples of such hybrid promoters include the ADH regulatory sequence linked to the GAP transcription activation region (U.S. Pat. Nos. 4,876,197 and 4,880,734). Other examples of hybrid promoters include promoters which consist of the regulatory sequences of either the ADH2, GAL4, GAL10, OR PHO5 genes, combined with the transcriptional activation region of a glycolytic enzyme gene such as GAP or PyK (EP-A-0 164 556). Furthermore, a yeast promoter can include naturally occurring promoters of non-yeast origin that have the ability to bind yeast RNA polymerase and initiate transcription. Examples of such promoters include, inter alia, [Cohen et al. (1980) *Proc. Natl. Acad. Sci. USA* 77:1078; Henikoff et al. (1981) *Nature* 283:835; Hollenberg et al. (1981) *Curr. Topics Microbiol. Immunol.* 96:119; Hollenberg et al. (1979) "The Expression of Bacterial Antibiotic Resistance Genes in the Yeast *Saccharomyces cerevisiae*," in: *Plasmids of Medical, Environmental and Commercial Importance* (eds. K. N. Timmis and A. Puhler); Mercerau-Puigalon et al. (1980) *Gene* 11:163; Panthier et al. (1980) *Curr. Genet.* 2:109;].

A DNA molecule may be expressed intracellularly in yeast. A promoter sequence may be directly linked with the DNA molecule, in which case the first amino acid at the N-terminus of the recombinant protein will always be a methionine, which is encoded by the ATG start codon. If desired, methionine at the N-terminus may be cleaved from the protein by in vitro incubation with cyanogen bromide.

Fusion proteins provide an alternative for yeast expression systems, as well as in mammalian, baculovirus, and bacterial expression systems. Usually, a DNA sequence encoding the N-terminal portion of an endogenous yeast protein, or other stable protein, is fused to the 5' end of heterologous coding sequences. Upon expression, this construct will provide a fusion of the two amino acid sequences. For example, the yeast or human superoxide dismutase (SOD) gene, can be linked at the 5' terminus of a foreign gene and expressed in yeast. The DNA sequence at the junction of the two amino acid sequences may or may not encode a cleavable site. See eg. EP-A-0 196 056. Another example is a ubiquitin fusion protein. Such a fusion protein is made with the ubiquitin region that preferably retains a site for a processing enzyme (eg. ubiquitin-specific processing protease) to cleave the ubiquitin from the foreign protein. Through this method, therefore, native foreign protein can be isolated (eg. WO88/024066).

Alternatively, foreign proteins can also be secreted from the cell into the growth media by creating chimeric DNA molecules that encode a fusion protein comprised of a leader sequence fragment that provide for secretion in yeast of the foreign protein. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell.

DNA encoding suitable signal sequences can be derived from genes for secreted yeast proteins, such as the yeast invertase gene (EP-A-0 012 873; JPO. 62,096,086) and the A-factor gene (U.S. Pat. No. 4,588,684). Alternatively, leaders of non-yeast origin, such as an interferon leader, exist that also provide for secretion in yeast (EP-A-0 060 057).

A preferred class of secretion leaders are those that employ a fragment of the yeast alpha-factor gene, which contains both a "pre" signal sequence, and a "pro" region. The types of alpha-factor fragments that can be employed include the full-length pre-pro alpha factor leader (about 83 amino acid residues) as well as truncated alpha-factor leaders (usually about 25 to about 50 amino acid residues) (U.S. Pat. Nos. 4,546,083 and 4,870,008; EP-A-0 324 274). Additional leaders employing an alpha-factor leader fragment that provides for secretion include hybrid alpha-factor leaders made with a presequence of a first yeast, but a pro-region from a second yeast alphafactor. (eg. see WO 89/02463.)

Usually, transcription termination sequences recognized by yeast are regulatory regions located 3' to the translation stop codon, and thus together with the promoter flank the coding sequence. These sequences direct the transcription of an mRNA which can be translated into the polypeptide encoded by the DNA. Examples of transcription terminator sequence and other yeast-recognized termination sequences, such as those coding for glycolytic enzymes.

Usually, the above described components, comprising a promoter, leader (if desired), coding sequence of interest, and transcription termination sequence, are put together into expression constructs. Expression constructs are often maintained in a replicon, such as an extrachromosomal element (eg. plasmids) capable of stable maintenance in a host, such as yeast or bacteria. The replicon may have two replication systems, thus allowing it to be maintained, for example, in yeast for expression and in a prokaryotic host for cloning and amplification. Examples of such yeast-bacteria shuttle vectors include YEp24 [Botstein et al. (1979) *Gene* 8:17–24], pCl/1 [Brake et al. (1984) *Proc. Natl. Acad. Sci USA* 81:4642–4646], and YRp17 [Stinchcomb et al. (1982) *J. Mol. Biol.* 158:157]. In addition, a replicon may be either a high or low copy number plasmid. A high copy number plasmid will generally have a copy number ranging from about 5 to about 200, and usually about 10 to about 150. A host containing a high copy number plasmid will preferably have at least about 10, and more preferably at least about 20. Enter a high or low copy number vector may be selected, depending upon the effect of the vector and the foreign protein on the host. See eg. Brake et al., supra.

Alternatively, the expression constructs can be integrated into the yeast genome with an integrating vector. Integrating vectors usually contain at least one sequence homologous to a yeast chromosome that allows the vector to integrate, and preferably contain two homologous sequences flanking the expression construct. Integrations appear to result from recombinations between homologous DNA in the vector and the yeast chromosome [Orr-Weaver et al (1983) *Methods in Enzymol.* 101:228–245]. An integrating vector may be directed to a specific locus in yeast by selecting the appropriate homologous sequence for inclusion in the vector. See Orr-Weaver et al., supra. One or more expression construct may integrate, possibly affecting levels of recombinant protein produced [Rine et al. (1983) *Proc. Natl. Acad. Sci. USA* 80:6750]. The chromosomal sequences included in the vector can occur either as a single segment in the vector, which results in the integration of the entire Vector, or two segments homologous to adjacent segments in the chromosome and flanking the expression construct in the vector, which can result in the stable integration of only the expression construct.

Usually, extrachromosomal and integrating expression constructs may contain selectable markers to allow for the selection of yeast strains that have been transformed. Selectable markers may include biosynthetic genes that can be expressed in the yeast host, such as ADE2, HIS4, LEU2, TRP1, and ALG7, and the G418 resistance gene, which confer resistance in yeast cells to tunicamycin and G418, respectively. In addition, a suitable selectable marker may also provide yeast with the ability to grow in the presence of toxic compounds, such as metal. For example, the presence of CUP1 allows yeast to grow in the presence of copper ions [Butt et al. (1987) *Microbial, Rev.* 51:351].

Alternatively, some of the above described components can be put together into transformation vectors. Transformation vectors are usually comprised of a selectable marker that is either maintained in a replicon or developed into an integrating vector, as described above.

Expression and transformation vectors, either extrachromosomal replicons or integrating vectors, have been developed for transformation into many yeasts. For example, expression vectors have been developed for, inter alia, the following yeasts: Candida albicans [Kurtz, et al. (1986) *Mol. Cell. Biol.* 6:142], Candida maltosa [Kunze, et al. (1985) *J. Basic Microbiol.* 25:141], Hansenula polymorpha [Gleeson, et al. (1986) *J. Gen. Microbiol.* 132:3459; Roggenkamp et al. (1986) *Mol. Gen. Genet.* 202:302], Kluyveromyces fragilis [Das, et al. (1984) *J. Bacteriol.* 158:1165], Kluyveromyces lactis [De Louvencourt et al. (1983) *J. Bacteriol.* 154:737; Van den Berg et al. (1990) *Bio/Technology* 8:135], Pichia guillerimondii [Kunze et al. (1985) *J. Basic Microbiol.* 25:141], Pichia pastoris [Cregg, et al. (1985) *Mol. Cell. Biol.* 5:3376; U.S. Pat. Nos. 4,837,148 and 4,929,555], Saccharomyces cerevisiae [Hinnen et al. (1978) *Proc. Natl. Acad. Sci. USA* 75:1929; Ito et al. (1983) *J. Bacteriol.* 153:163], Schizosaccharomyces pombe [Beach and Nurse (1981) *Nature* 300:706], and Yarrowia lipolytica [Davidow, et al. (1985) *Curr. Genet.* 10:380471 Gaillardin, et al. (1985) *Curr. Genet.* 10:49].

Methods of introducing exogenous DNA into yeast hosts are well-known in the art, and usually include either the transformation of spheroplasts or of intact yeast cells treated with alkali cations. Transformation procedures usually vary with the yeast species to be transformed. See eg. [Kurtz et al. (1986) *Mol. Cell. Biol.* 6:142; Kunze et al. (1985) *J. Basic Microbiol.* 25:141; *Candida*]; [Gleeson et al. (1986) *J. Gen. Microbiol.* 132:3459; Roggenkamp et al. (1986) *Mol. Gen. Genet.* 202:302; *Hansenula*]; Das et al. (1984) *J. Bacteriol.* 158:1165; De Louvencourt et al. (1983) *J. Bacteriol.* 154: 1165; Van den Berg et al. (1990) *Bio/Technology* 8:135; *Kluyveromyces*]; [Cregg et al. (1985) *Mol. Cell. Biol.* 5:3376; Kunze et al. (1985) *J. Basic Microbiol.* 25:141; U.S. Pat. Nos. 4,837,148 and 4,929,555; *Pichia*]; [Hinnen et al. (1978) *Proc. Natl. Acad. Sci. USA* 75; 1929; Ito et al. (1983) *J. Bacteriol.* 153:163 *Saccharomyces*]; [Beach and Nurse (1981) *Nature* 300:706; *Schizosaccharomyces*]; [Davidow et al. (1985) *Curr. Genet.* 10:39; Gaillardin et al. (1985) *Curr. Genet.* 10:49; *Yarrowia*].

Antibodies

As used herein, the term "antibody" refers to a polypeptide or group of polypeptides composed of at least one antibody combining site. An "antibody combining site" is the three-dimensional binding space with an internal surface shape and charge distribution complementary to the features of an epitope of an antigen, which allows a binding of the antibody with the antigen. "Antibody" includes, for example, vertebrate antibodies, hybrid antibodies, chimeric antibodies, humanised antibodies, altered antibodies, univalent antibodies, Fab proteins, and single domain antibodies.

Antibodies against the proteins of the invention are useful for affinity chromatography, immunoassays, and distinguishing/identifying Neisserial proteins.

Antibodies to the proteins of the invention, both polyclonal and monoclonal, may be prepared by conventional methods. In general, the protein is first used to immunize a suitable animal, preferably a mouse, rat, rabbit or goat. Rabbits and goats are preferred for the preparation of polyclonal sera due to the volume of serum obtainable, and the availability of labeled anti-rabbit and anti-goat antibodies. Immunization is generally performed by mixing or emulsifying the protein in saline, preferably in an adjuvant such as Freund's complete adjuvant, and injecting the mixture or emulsion parenterally (generally subcutaneously or intramuscularly). A dose of 50–200 µg/injection is typically sufficient. Immunization is generally boosted 2–6 weeks later with one or more injections of the protein in saline, preferably using Freund's incomplete adjuvant. One may alternatively generate antibodies by in vitro immunization using methods known in the art, which for the purposes of this invention is considered equivalent to in vivo immunization. Polyclonal antisera is obtained by bleeding the immunized animal into a glass or plastic container, incubating the blood at 25° C. for one hour, followed by incubating at 4° C. for 2–18 hours. The serum is recovered by centrifugation (eg. 1,000 g for 10 minutes). About 20–50 ml per bleed may be obtained from rabbits.

Monoclonal antibodies are prepared using the standard method of Kohler & Milstein [*Nature* (1975) 256:495–96], or a modification thereof. Typically, a mouse or rat is immunized as described above. However, rather than bleeding the animal to extract serum, the spleen (and optionally several large lymph nodes) is removed and dissociated into single cells. If desired, the spleen cells may be screened (after removal of nonspecifically adherent cells) by applying a cell suspension to a plate or well coated with the protein antigen. B-cells expressing membrane-bound immunoglobulin specific for the antigen bind to the plate, and are not rinsed away with the rest of the suspension. Resulting B-cells, or all dissociated spleen cells, are then induced to fuse with myeloma cells to form hybridomas, and are cultured in a selective medium (eg. hypoxanthine, aminopterin, thymidine medium, "HAT"). The resulting hybridomas are plated by limiting dilution, and are assayed for the production of antibodies which bind specifically to the immunizing antigen (and which do not bind to unrelated antigens). The selected MAb-secreting hybridomas are then cultured either in vitro (eg. in tissue culture bottles or hollow fiber reactors), or in vivo (as ascites in mice).

If desired, the antibodies (whether polyclonal or monoclonal) may be labeled using conventional techniques. Suitable labels include fluorophores, chromophores, radioactive atoms (particularly $^{32}P$ and $^{125}I$), electron-dense reagents, enzymes, and ligands having specific binding partners. Enzymes are typically detected by their activity. For example, horseradish peroxidase is usually detected by its ability to convert 3,3',5,5'-tetramethylbenzidine (TMB) to a blue pigment, quantifiable with a spectrophotometer. "Specific binding partner" refers to a protein capable of binding a ligand molecule with high specificity, as for example in the case of an antigen and a monoclonal antibody specific therefor. Other specific binding partners include biotin and avidin or streptavidin, IgG and protein A, and the numerous receptor-ligand couples known in the art. It should be understood that the above description is not meant to categorize the various labels into distinct classes, as the same label may serve in several different modes. For example, $^{125}$I may serve as a radioactive label or as an electron-dense reagent. HRP may serve as enzyme or as antigen for a MAb. Further, one may combine various labels for desired effect. For example, MAbs and avidin also require labels in the practice of this invention: thus, one might label a MAb with biotin, and detect its presence with avidin labeled with $^{125}$I, or with an anti-biotin MAb labeled with HRP. Other permutations and possibilities will be readily apparent to those of ordinary skill in the art, and are considered as equivalents within the scope of the instant invention.

Pharmaceutical Compositions

Pharmaceutical compositions can comprise either polypeptides, antibodies, or nucleic acid of the invention. The pharmaceutical compositions will comprise a therapeutically effective amount of either polypeptides, antibodies, or polynucleotides of the claimed invention.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature. The precise effective amount for a subject will depend upon the subject's size and health, the nature and extent of the condition, and the therapeutics or combination of therapeutics selected for administration. Thus, it is not useful to specify an exact effective amount in advance. However, the effective amount for a given situation can be determined by routine experimentation and is within the judgement of the clinician.

For purposes of the present invention, an effective dose will be from about 0.01 mg/kg to 50 mg/kg or 0.05 mg/kg to about 10 mg/kg of the DNA constructs in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which may be administered without undue toxicity. Suitable carriers may be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art.

Pharmaceutically acceptable salts can be used therein, for example, mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in Remington's Pharmaceutical Sciences (Mack Pub. Co., N.J. 1991).

Pharmaceutically acceptable carriers in therapeutic compositions may contain liquids such as water, saline, glycerol and ethanol. Additionally, auxiliary substances, such as wetting or emulsifying agents, pH buffering substances, and the like, may be present in such vehicles. Typically, the therapeutic compositions are prepared as injectables, either as liquid solutions or suspensions; solid forms suitable for solution in, or suspension in, liquid vehicles prior to injection may also be prepared. Liposomes are included within the definition of a pharmaceutically acceptable carrier.

Delivery Methods

Once formulated, the compositions of the invention can be administered directly to the subject. The subjects to be treated can be animals; in particular, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (eg. see WO98/20734), needles, and gene guns or hyposprays. Dosage treatment may be a single dose schedule or a multiple dose schedule.

Vaccines

Vaccines according to the invention may either be prophylactic (ie. to prevent infection) or therapeutic (ie. to treat disease after infection).

Such vaccines comprise immunising antigen(s), immunogen(s), polypeptide(s), protein(s) or nucleic acid, usually in combination with "pharmaceutically acceptable carriers," which include any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, lipid aggregates (such as oil droplets or liposomes), and inactive virus particles. Such carriers are well known to those of ordinary skill in the art. Additionally, these carriers may function as immunostimulating agents ("adjuvants"). Furthermore, the antigen or immunogen may be conjugated to a bacterial toxoid, such as a toxoid from diphtheria, tetanus, cholera, *H. pylori*, etc. pathogens.

Preferred adjuvants to enhance effectiveness of the composition include, but are not limited to: (1) aluminum salts (alum), such as aluminum hydroxide, aluminum phosphate, aluminum sulfate, etc; (2) oil-in-water emulsion formulations (with or without other specific immunostimulating agents such as muramyl peptides (see below) or bacterial cell wall components), such as for example (a) MF59™ (WO 90/14837; Chapter 10 in *Vaccine design: the subunit and adjuvant approach*, eds. Powell & Newman, Plenum Press 1995), containing 5% Squalene, 0.5% Tween 80, and 0.5% Span 85 (optionally containing various amounts of MTP-PE (see below), although not required) formulated into submicron particles using a microfluidizer such as Model 110Y microfluidizer (Microfluidics, Newton, Mass.), (b) SAF, containing 10% Squalane, 0.4% Tween 80, 5% pluronic-blocked polymer L121, and thr-MDP (see below) either microfluidized into a submicron emulsion or vortexed to generate a larger particle size emulsion, and (c) Ribi™ adjuvant system (RAS), (Ribi Immunochem, Hamilton, Mont.) containing 2% Squalene, 0.2% Tween 80, and one or more bacterial cell wall components from the group consisting of monophosphorylipid A (MPL), trehalose dimycolate (TDM), and cell wall skeleton (CWS), preferably MPL+CWS (Detox™); (3) saponin adjuvants, such as Stimulon™ (Cambridge Bioscience, Worcester, Mass.) may be used or particles generated therefrom such as ISCOMs (immunostimulating complexes); (4) Complete Freund's Adjuvant (CFA) and Incomplete Freund's Adjuvant (IFA); (5) cytokines, such as interleukins (eg. IL-1, IL-2, IL-4, IL-5, IL-6, IL-7, IL-12, etc.), interferons (eg. gamma interferon), macrophage colony stimulating factor (M-CSF), tumor necrosis factor (TNF), etc; and (6) other substances that act as immunostimulating agents to enhance the effectiveness of the composition. Alum and MF59™ are preferred.

As mentioned above, muramyl peptides include, but are not limited to, N-acetyl-muramyl-L-threonyl-D-isoglutamine (thr-MDP), N-acetyl-normuramyl-L-alanyl-D-isoglutamine (nor-MDP), N-acetylmuramyl-L-alanyl-D-isoglutaminyl-L-alanine-2-(1'-2'-dipalmitoyl-sn-glycero-3-hydroxyphosphoryloxy)-ethylamine (MTP-PE), etc.

The immunogenic compositions (eg. the immunising antigen/immunogen/polypeptide/protein/nucleic acid, pharmaceutically acceptable carrier, and adjuvant) typically will contain diluents, such as water, saline, glycerol, ethanol, etc. Additionally, auxiliary substances, such as wetting or emulsifying agents, pH buffering substances, and the like, may be present in such vehicles.

Typically, the immunogenic compositions are prepared as injectables, either as liquid solutions or suspensions; solid forms suitable for solution in, or suspension in, liquid vehicles prior to injection may also be prepared. The preparation also may be emulsified or encapsulated in liposomes for enhanced adjuvant effect, as discussed above under pharmaceutically acceptable carriers.

Immunogenic compositions used as vaccines comprise an immunologically effective amount of the antigenic or immunogenic polypeptides, as well as any other of the above-mentioned components, as needed. By "immunologically effective amount", it is meant that the administration of that amount to an individual, either in a single dose or as part of a series, is effective for treatment or prevention. This amount varies depending upon the health and physical condition of the individual to be treated, the taxonomic group of individual to be treated (eg. nonhuman primate, primate, etc.), the capacity of the individual's immune system to synthesize antibodies, the degree of protection desired, the formulation of the vaccine, the treating doctor's assessment of the medical situation, and other relevant factors. It is expected that the amount will fall in a relatively broad range that can be determined through routine trials.

The immunogenic compositions are conventionally administered parenterally, eg. by injection, either subcutaneously, intramuscularly, or transdermally/transcutaneously (eg. WO98/20734). Additional formulations suitable for other modes of administration include oral and pulmonary formulations, suppositories, and transdermal applications. Dosage treatment may be a single dose schedule or a multiple dose schedule. The vaccine may be administered in conjunction with other immunoregulatory agents.

As an alternative to protein-based vaccines, DNA vaccination may be employed [eg. Robinson & Torres (1997) Seminars in Immunology 9:271–283; Donnelly et al. (1997) Annu Rev Immunol 15:617–648; see later herein].

Gene Delivery Vehicles

Gene therapy vehicles for delivery of constructs including a coding sequence of a therapeutic of the invention, to be delivered to the mammal for expression in the mammal, can be administered either locally or systemically. These constructs can utilize viral or non-viral vector approaches in in vivo or ex vivo modality. Expression of such coding sequence can be induced using endogenous mammalian or heterologous promoters. Expression of the coding sequence in vivo can be either constitutive or regulated.

The invention includes gene delivery vehicles capable of expressing the contemplated nucleic acid sequences. The gene delivery vehicle is preferably a viral vector and, more preferably, a retroviral, adenoviral, adeno-associated viral (AAV), herpes viral, or alphavirus vector. The viral vector can also be an astrovirus, coronavirus, orthomyxovirus, papovavirus, paramyxovirus, parvovirus, picornavirus, poxvirus, or togavirus viral vector. See generally, Jolly (1994) Cancer Gene Therapy 1:51–64; Kimura (1994) Human Gene Therapy 5:845–852; Connelly (1995) Human Gene Therapy 6:185–193; and Kaplitt (1994) Nature Genetics 6:148–153.

Retroviral vectors are well known in the art and we contemplate that any retroviral gene therapy vector is employable in the invention, including B, C and D type retroviruses, xenotropic retroviruses (for example, NZB-X1, NZB-X2 and NZB9-1 (see O'Neill (1985) J. Virol. 53:160) polytropic retroviruses eg. MCF and MCF-MLV (see Kelly (1983) J. Virol. 45:291), spumaviruses and lentiviruses. See RNA Tumor Viruses, Second Edition, Cold Spring Harbor Laboratory, 1985.

Portions of the retroviral gene therapy vector may be derived from different retroviruses. For example, retrovector LTRs may be derived from a Murine Sarcoma Virus, a tRNA binding site from a Rous Sarcoma Virus, a packaging signal from a Murine Leukemia Virus, and an origin of second strand synthesis from an Avian Leukosis Virus.

These recombinant retroviral vectors may be used to generate transduction competent retroviral vector particles by introducing them into appropriate packaging cell lines (see U.S. Pat. No. 5,591,624). Retrovirus vectors can be constructed for site-specific integration into host cell DNA by incorporation of a chimeric integrase enzyme into the retroviral particle (see WO96/37626). It is preferable that the recombinant viral vector is a replication defective recombinant virus.

Packaging cell lines suitable for use with the above-described retrovirus vectors are well known in the art, are readily prepared (see WO95/30763 and WO92/05266), and can be used to create producer cell lines (also termed vector cell lines or "VCLs") for the production of recombinant vector particles. Preferably, the packaging cell lines are made from human parent cells (eg. HT1080 cells) or mink parent cell lines, which eliminates inactivation in human serum.

Preferred retroviruses for the construction of retroviral gene therapy vectors include Avian Leukosis Virus, Bovine Leukemia, Virus, Murine Leukemia Virus, Mink-Cell Focus-Inducing Virus, Murine Sarcoma Virus, Reticuloendotheliosis Virus and Rous Sarcoma Virus. Particularly preferred Murine Leukemia Viruses include 4070A and 1504A (Hartley and Rowe (1976) J Virol 19:19–25), Abelson (ATCC No. VR-999), Friend (ATCC No. VR-245), Graffi, Gross (ATCC No1 VR-590), Kirsten, Harvey Sarcoma Virus and Rauscher (ATCC No. VR-998) and Moloney Murine Leukemia Virus (ATCC No. VR-190). Such retroviruses may be obtained from depositories or collections such as the American Type Culture Collection ("ATCC") in Rockville, Md. or isolated from known sources using commonly available techniques.

Exemplary known retroviral gene therapy vectors employable in this invention include those described in patent applications GB2200651, EP0415731, EP0345242, EP0334301, WO89/02468; WO89/05349, WO89/09271, WO90/02806, WO90/07936, WO94/03622, WO93/25698, WO93/25234, WO93/11230, WO93/10218, WO91/02805, WO91/02825, WO95/07994, U.S. Pat. No. 5,219,740, U.S. Pat. No. 4,405,712, U.S. Pat. No. 4,861,719, U.S. Pat. No. 4,980,289, U.S. Pat. No. 4,777,127, U.S. Pat. No. 5,591,624. See also Vile (1993) *Cancer Res* 53:3860–3864; Vile (1993) *Cancer Res* 53:962–967; Ram (1993) *Cancer Res* 53 (1993) 83–88; Takamiya (1992) *J Neurosci Res* 33:493–503; Baba (1993) *J Neurosurg* 79:729–735; Mann (1983) *Cell* 33:153; Cane (1984) *Proc Natl Acad Sci* 81:6349; and Miller (1990) *Human Gene Therapy* 1.

Human adenoviral gene therapy vectors are also known in the art and employable in this invention. See, for example, Berkner (1988) *Biotechniques* 6:616 and Rosenfeld (1991) *Science* 252:431, and WO93/07283, WO93/06223, and WO93/07282. Exemplary known adenoviral gene therapy vectors employable in this invention include those described in the above referenced documents and in WO94/12649, WO93/03769, WO93/19191, WO94/28938, WO95/11984, WO95/00655, WO95/27071, WO95/29993, WO95/34671, WO96/05320, WO94/08026, WO94/11506, WO93/06223, WO94/24299, WO95/14102, WO95/24297, WO95/02697, WO94/28152, WO94/24299, WO95/09241, WO95/25807, WO95/05835, WO94/18922 and WO95/09654. Alternatively, administration of DNA linked to killed adenovirus as described in Curiel (1992) *Hum. Gene Ther.* 3:147–154 may be employed. The gene delivery vehicles of the invention also include adenovirus associated virus (AAV) vectors. Leading and preferred examples of such vectors for use in this invention are the AAV-2 based vectors disclosed in Srivastava, WO93/09239. Most preferred AAV vectors comprise the two AAV inverted terminal repeats in which the native D-sequences are modified by substitution of nucleotides, such that at least 5 native nucleotides and up to 18 native nucleotides, preferably at least 10 native nucleotides up to 18 native nucleotides, most preferably 10 native nucleotides are retained and the remaining nucleotides of the D-sequence are deleted or replaced with non-native nucleotides. The native D-sequences of the AAV inverted terminal repeats are sequences of 20 consecutive nucleotides in each AAV inverted terminal repeat (ie. there is one sequence at each end) which are not involved in HP formation. The non-native replacement nucleotide may be any nucleotide other than the nucleotide found in the native D-sequence in the same position. Other employable exemplary AAV vectors are pWP-19, pWN-1, both of which are disclosed in Nahreini (1993) *Gene* 124:257–262. Another example of such an AAV vector is psub201 (see Samulski (1987) *J. Virol.* 61:3096). Another exemplary AAV vector is the Double-D ITR vector. Construction of the Double-D ITR vector is disclosed in U.S. Pat. No. 5,478,745. Still other vectors are those disclosed in Carter U.S. Pat. No. 4,797,368 and Muzyczka U.S. Pat. No. 5,139,941, Chartejee U.S. Pat. No. 5,474,935, and Kotin WO94/288157. Yet a further example of an AAV vector employable in this invention is SSV9AFABTKneo, which contains the AFP enhancer and albumin promoter and directs expression predominantly in the liver. Its structure and construction are disclosed in Su (1996) *Human Gene Therapy* 7:463–470. Additional AAV gene therapy vectors are described in U.S. Pat. No. 5,354,678, U.S. Pat. No. 5,173,414, U.S. Pat. No. 5,139,941, and U.S. Pat. No. 5,252,479.

The gene therapy vectors of the invention also include herpes vectors. Leading and preferred examples are herpes simplex virus vectors containing a sequence encoding a thymidine kinase polypeptide such as those disclosed in U.S. Pat. No. 5,288,641 and EP0176170 (Roizman). Additional exemplary herpes simplex virus vectors include HFEM/ICP6-LacZ disclosed in WO95/04139 (Wistar Institute), pHSVlac described in Geller (1988) *Science* 241:1667–1669 and in WO90/09441 and WO92/07945, HSV Us3::pgC-lacZ described in Fink (1992) *Human Gene Therapy* 3:11–19 and HSV 7134, 2 RH 105 and GAL4 described in EP 0453242 (Breakefield), and those deposited with the ATCC as accession numbers ATCC VR-977 and ATCC VR-260.

Also contemplated are alpha virus gene therapy vectors that can be employed in this invention. Preferred alpha virus vectors are Sindbis viruses vectors. Togaviruses, Semliki Forest virus (ATCC VR-67; ATCC VR-1247), Middleberg virus (ATCC VR-370), Ross River virus (ATCC VR-373; ATCC VR-1246), Venezuelan equine encephalitis virus (ATCC VR923; ATCC VR-1250; ATCC VR-1249; ATCC VR-532), and those described in U.S. Pat. Nos. 5,091,309, 5,217,879, and WO92/10578. More particularly, those alpha virus vectors described in U.S. Ser. No. 08/405,627, filed Mar. 15, 1995, WO94/21792, WO92/10578, WO95/07994, U.S. Pat. No. 5,091,309 and U.S. Pat. No. 5,217,879 are employable. Such alpha viruses may be obtained from depositories or collections such as the ATCC in Rockville, Md. or isolated from known sources using commonly available techniques. Preferably, alphavirus vectors with reduced cytotoxicity are used (see U.S. Ser. No. 08/679,640).

DNA vector systems such as eukaryotic layered expression systems are also useful for expressing the nucleic acids of the invention. See WO95/07994 for a detailed description of eukaryotic layered expression systems. Preferably, the eukaryotic layered expression systems of the invention are derived from alphavirus vectors and most preferably from Sindbis viral vectors.

Other viral vectors suitable for use in the present invention include those derived from poliovirus, for example ATCC VR-58 and those described in Evans, Nature 339 (1989) 385 and Sabin (1973) *J. Biol. Standardization* 1:115; rhinovirus, for example ATCC VR-1110 and those described in Arnold (1990) *J Cell Biochem* L401; pox viruses such as canary pox virus or vaccinia virus, for example ATCC VR-111 and ATCC VR-2010 and those described in Fisher-Hoch (1989) *Proc Natl Acad Sci* 86:317; Flexner (1989) *Ann NY Acad Sci* 569:86, Flexner (1990) *Vaccine* 8:17; in U.S. Pat. No. 4,603,112 and U.S. Pat. No. 4,769,330 and WO89/01973; SV40 virus, for example ATCC VR-305 and those described in Mulligan (1979) *Nature* 277:108 and Madzak (1992) *J Gen Virol* 73:1533; influenza virus, for example ATCC VR-797 and recombinant influenza viruses made employing reverse genetics techniques as described in U.S. Pat. No. 5,166,057 and in Enami (1990) *Proc Natl Acad Sci* 87:3802–3805; Enami & Palese (1991) *J Virol* 65:2711–2713 and Luytjes (1989) *Cell* 59:110, (see also McMichael (1983) *NEJ Med* 309:13, and Yap (1978) *Nature* 273:238 and *Nature* (1979) 277:108); human immunodeficiency virus as described in EP-0386882 and in Buchschacher (1992) *J. Virol.* 66:2731; measles virus, for example ATCC VR-67 and VR-1247 and those described in EP-0440219; Aura virus, for example ATCC VR-368; Bebaru virus, for example ATCC VR-600 and ATCC VR-1240; Cabassou virus, for example ATCC VR-922; Chikungunya virus, for example ATCC VR-64 and ATCC VR-1241; Fort Morgan Virus, for example ATCC VR-924; Getah virus, for example ATCC VR-369 and ATCC VR-1243; Kyzylagach virus, for example ATCC VR-927; Mayaro virus, for example ATCC VR-66; Mucambo virus, for example ATCC VR-580 and ATCC VR-1244; Ndumu virus, for example ATCC VR-371; Pixuna virus, for example ATCC VR-372 and ATCC VR-1245; Tonate virus, for example ATCC VR-925; Triniti virus, for example ATCC VR-469; Una virus, for example ATCC VR-374; Whataroa virus, for example ATCC VR-926; Y-62-33 virus, for example ATCC VR-375; O'Nyong virus, Eastern encephalitis virus, for example ATCC VR-65 and ATCC VR-1242; Western encephalitis virus, for example ATCC VR-70, ATCC VR-1251, ATCC VR-622 and ATCC VR-1252; and coronavirus, for example ATCC VR-740 and those described in Hamre (1966) *Proc Soc Exp Biol Med* 121:190.

Delivery of the compositions of this invention into cells is not limited to the above mentioned viral vectors. Other delivery methods and media may be employed such as, for example, nucleic acid expression vectors, polycationic condensed DNA linked or unlinked to killed adenovirus alone, for example see U.S. Ser. No. 08/366,787, filed Dec. 30, 1994 and Curiel (1992) *Hum Gene Ther* 3:147–154 ligand linked DNA, for example see Wu (1989) *J Biol Chem* 264:16985–16987, eucaryotic cell delivery vehicles cells, for example see U.S. Ser. No. 08/240,030, filed May 9, 1994, and U.S. Ser. No. 08/404,796, deposition of photopolymerized hydrogel materials, hand-held gene transfer particle gun, as described in U.S. Pat. No. 5,149,655, ionizing radiation as described in U.S. Pat. No. 5,206,152 and in WO92/11033, nucleic charge neutralization or fusion with cell membranes. Additional approaches are described in Philip (1994) *Mol Cell Biol* 14:2411–2418 and in Woffendin (1994) *Proc Natl Acad Sci* 91:1581–1585.

Particle mediated gene transfer may be employed, for example see U.S. Ser. No. 60/023,867. Briefly, the sequence can be inserted into conventional vectors that contain conventional control sequences for high level expression, and then incubated with synthetic gene transfer molecules such as polymeric DNA-binding cations like polylysine, protamine, and albumin, linked to cell targeting ligands such as asialoorosomucoid, as described in Wu & Wu (1987) *J. Biol. Chem.* 262:4429–4432, insulin as described in Hucked (1990) *Biochem Pharmacol* 40:253–263, galactose as described in Plank (1992) *Bioconjugate Chem* 3:533–539, lactose or transferrin.

Naked DNA may also be employed. Exemplary naked DNA introduction methods are described in WO 90/11092 and U.S. Pat. No. 5,580,859. Uptake efficiency may be improved using biodegradable latex beads. DNA coated latex beads are efficiently transported into cells after endocytosis initiation by the beads. The method may be improved further by treatment of the beads to increase hydrophobicity and thereby facilitate disruption of the endosome and release of the DNA into the cytoplasm.

Liposomes that can act as gene delivery vehicles are described in U.S. Pat. No. 5,422,120, WO95/13796, WO94/23697, WO91/14445 and EP-524,968. As described in U.S. Ser. No. 60/023,867, on non-viral delivery, the nucleic acid sequences encoding a polypeptide can be inserted into conventional vectors that contain conventional control sequences for high level expression, and then be incubated with synthetic gene transfer molecules such as polymeric DNA-binding cations like polylysine, protamine, and albumin, linked to cell targeting ligands such as asialoorosomucoid, insulin, galactose, lactose, or transferrin. Other delivery systems include the use of liposomes to encapsulate DNA comprising the gene under the control of a variety of tissue-specific or ubiquitously-active promoters. Further non-viral delivery suitable for use includes mechanical delivery systems such as the approach described in Woffendin et al (1994) *Proc. Nail. Acad. Sci. USA* 91(24):115.81–11585. Moreover, the coding sequence and the product of expression of such can be delivered through deposition of photopolymerized hydrogel materials. Other conventional methods for gene delivery that can be used for delivery of the coding sequence include, for example, use of hand-held gene transfer particle gun, as described in U.S. Pat. No. 5,149,655; use of ionizing radiation for activating transferred gene, as described in U.S. Pat. No. 5,206,152 and WO92/11033

Exemplary liposome and polycationic gene delivery vehicles are those described in U.S. Pat. Nos. 5,422,120 and 4,762,915; in WO 95/13796; WO94/23697; and WO91/14445; in EP-0524968; and in Stryer, Biochemistry, pages 236–240 (1975) W.H. Freeman, San Francisco; Szoka (1980) *Biochem Biophys Acta* 600:1; Bayer (1979) *Biochem Biophys Acta* 550:464; Rivnay (1987) *Meth Enzymol* 149: 119; Wang (1987) *Proc Natl Acad Sci* 84:7851; Plant (1989) *Anal Biochem* 176:420.

A polynucleotide composition can comprises therapeutically effective amount of a gene therapy vehicle, as the term is defined above. For purposes of the present invention, an effective dose will be from about 0.01 mg/kg to 50 mg/kg or 0.05 mg/kg to about 10 mg/kg of the DNA constructs in the individual to which it is administered.

Delivery Methods

Once formulated, the polynucleotide compositions of the invention can be administered (1) directly to the subject; (2) delivered ex vivo, to cells derived from the subject; or (3) in vitro for expression of recombinant proteins. The subjects to be treated can be mammals or birds. Also, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (eg. see WO98/20734), needles, and gene guns or hyposprays. Dosage treatment may be a single dose schedule or a multiple dose schedule.

Methods for the ex vivo delivery and reimplantation of transformed cells into a subject are known in the art and described in eg. WO93/14778. Examples of cells useful in ex vivo applications include, for example, stem cells, particularly hematopoetic, lymph cells, macrophages, dendritic cells, or tumor cells.

Generally, delivery of nucleic acids for both ex vivo and in vitro applications can be accomplished by the following procedures, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Polynucleotide and Polypeptide Pharmaceutical Compositions

In addition to the pharmaceutically acceptable carriers and salts described above, the following additional agents can be used with polynucleotide and/or polypeptide compositions.

A. Polypeptides

One example are polypeptides which include, without limitation: asioloorosomucoid (ASOR); transferrin; asialoglycoproteins; antibodies; antibody fragments; ferritin; interleukins; interferons, granulocyte, macrophage colony stimulating factor (GM-CSF), granulocyte colony stimulating factor (G-CSF), macrophage colony stimulating factor (M-CSF), stem cell factor and erythropoietin. Viral antigens, such as envelope proteins, can also be used. Also, proteins from other invasive organisms, such as the 17 amino acid peptide from the circumsporozoite protein of *plasmodium falciparum* known as RII.

B. Hormones, Vitamins, Etc.

Other groups that can be included are, for example: hormones, steroids, androgens, estrogens, thyroid hormone, or vitamins, folic acid.

C. Polyalkylenes, Polysaccharides. Etc.

Also, polyalkylene glycol can be included with the desired polynucleotides/polypeptides. In a preferred embodiment, the polyalkylene glycol is polyethlylene glycol. In addition, mono-, di-, or polysaccharides can be included. In a preferred embodiment of this aspect, the polysaccharide is dextran or DEAE-dextran. Also, chitosan and poly(lactide-co-glycolide)

D. Lipids, and Liposomes

The desired polynucleotide/polypeptide can also be encapsulated in lipids or packaged in liposomes prior to delivery to the subject or to cells derived therefrom.

Lipid encapsulation is generally accomplished using liposomes which are able to stably bind or entrap and retain nucleic acid. The ratio of condensed polynucleotide to lipid preparation can vary but will generally be around 1:1 (mg DNA:micromoles lipid), or more of lipid. For a review of the use of liposomes as carriers for delivery of nucleic acids, see, Hug and Sleight (1991) *Biochim. Biophys. Acta.* 1097: 1–17; Straubinger (1983) *Meth. Enzymol.* 101:512–527.

Liposomal preparations for use in the present invention include cationic (positively charged), anionic (negatively charged) and neutral preparations. Cationic liposomes have been shown to mediate intracellular delivery of plasmid DNA (Felgner (1987) *Proc. Natl. Acad. Sci. USA* 84:7413–7416); mRNA (Malone (1989) *Proc. Natl. Acad. Sci. USA* 86:6077–6081); and purified transcription factors (Debs (1990) *J. Biol. Chem.* 265:10189–10192), in functional form.

Cationic liposomes are readily available. For example, N[1-2,3-dioleyloxy)propyl]-N,N,N-triethylammonium (DOTMA) liposomes are available under the trademark Lipofectin, from GIBCO BRL, Grand Island, N.Y. (See, also, Felgner supra). Other commercially available liposomes include transfectace (DDAB/DOPE) and DOTAP/DOPE (Boerhinger). Other cationic liposomes can be prepared from readily available materials using techniques well known in the art. See, eg. Szoka (1978) *Proc. Natl. Acad. Sci. USA* 75:4194–4198; WO90/11092 for a description of the synthesis of DOTAP (1,2-bis(oleoyloxy)-3-(trimethylammonia)propane) liposomes.

Similarly, anionic and neutral liposomes are readily available, such as from Avanti Polar Lipids (Birmingham, Ala.), or can be easily prepared using readily available materials. Such materials include phosphatidyl choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

The liposomes can comprise multilammelar vesicles (MLVs), small unilamellar vesicles (SUVs), or large unilamellar vesicles (LUVs). The various liposome-nucleic acid complexes are prepared using methods known in the art. See eg. Straubinger (1983) *Meth. Immunol.* 101:512–527; Szoka (1978) *Proc. Natl. Acad. Sci. USA* 75:4194–4198; Papahadjopoulos (1975) *Biochim. Biophys. Acta* 394:483; Wilson (1979) *Cell* 17:77); Deamer & Bangham (1976) *Biochim. Biophys. Acta* 443:629; Ostro (1977) *Biochem. Biophys. Res. Commun.* 76:836; Fraley (1979) *Proc. Natl. Acad. Sci. USA* 76:3348); Enoch & Strittmatter (1979) *Proc. Natl. Acad. Sci. USA* 76:145; Fraley (1980) *J. Biol. Chem.* (1980) 255:10431; Szoka & Papahadjopoulos (1978) *Proc. Natl. Acad. Sci. USA* 75:145; and Schaefer-Ridder (1982) *Science* 215:166.

E. Lipoproteins

In addition, lipoproteins can be included with the polynucleotide/polypeptide to be delivered. Examples of lipoproteins to be utilized include: chylomicrons, HDL, IDL, LDL, and VLDL. Mutants, fragments, or fusions of these proteins can also be used. Also, modifications of naturally occurring lipoproteins can be used, such as acetylated LDL. These lipoproteins can target the delivery of polynucleotides to cells expressing lipoprotein receptors. Preferably, if lipoproteins are including with the polynucleotide to be delivered, no other targeting ligand is included in the composition.

Naturally occurring lipoproteins comprise a lipid and a protein portion. The protein portion are known as apoproteins. At the present, apoproteins A, B, C, D, and E have been isolated and identified. At least two of these contain several proteins, designated by Roman numerals, AI, AII, AIV; CI, CII, CIII.

A lipoprotein can comprise more than one apoprotein. For example, naturally occurring chylomicrons comprises of A, B, C, and E, over time these lipoproteins lose A and acquire C and E apoproteins. VLDL comprises A, B, C, and E apoproteins, LDL comprises apoprotein B; and HDL comprises apoproteins A, C, and E.

The amino acid of these apoproteins are known and are described in, for example, Breslow (1985) Annu Rev. Biochem 54:699; Law (1986) Adv. Exp Med. Biol. 151:162; Chen (1986) J Biol Chem 261:12918; Kane (1980) Proc Natl Acad Sci USA 77:2465; and Utermann (1984) Hum Genet 65:232.

Lipoproteins contain a variety of lipids including, triglycerides, cholesterol (free and esters), and phospholipids. The composition of the lipids varies in naturally occurring lipoproteins. For example, chylomicrons comprise mainly triglycerides. A more detailed description of the lipid content of naturally occurring lipoproteins can be found, for example, in *Meth. Enzymol.* 128 (1986). The composition of the lipids are chosen to aid in conformation of the apoprotein for receptor binding activity. The composition of lipids can also be chosen to facilitate hydrophobic interaction and association with the polynucleotide binding molecule.

Naturally occurring lipoproteins can be isolated from serum by ultracentrifugation, for instance. Such methods are described in *Meth. Enzymol.* (supra); Pitas (1980) *J. Biochem.* 255:5454–5460 and Mahey (1979) *J. Clin. Invest* 64:743–750. Lipoproteins can also be produced by in vitro or recombinant methods by expression of the apoprotein genes in a desired host cell. See, for example, Atkinson (1986) *Annu Rev Biophys Chem* 15:403 and Radding (1958) *Biochim Biophys Acta* 30: 443. Lipoproteins can also be purchased from commercial suppliers, such as Biomedical Technologies, Inc., Stoughton, Mass., USA. Further description of lipoproteins can be found in WO98/06437.

F. Polycationic Agents

Polycationic agents can be included, with or without lipoprotein, in a composition with the desired polynucleotide/polypeptide to be delivered.

Polycationic agents, typically, exhibit a net positive charge at physiological relevant pH and are capable of neutralizing the electrical charge of nucleic acids to facilitate delivery to a desired location. These agents have both in vitro, ex vivo, and in vivo applications. Polycationic agents can be used to deliver nucleic acids to a living subject either intramuscularly, subcutaneously, etc.

The following are examples of useful polypeptides as polycationic agents: polylysine, polyarginine, polyornithine, and prolamine. Other examples include histones, protamines, human serum albumin, DNA binding proteins, non-histone chromosomal proteins, coat proteins from DNA viruses, such as (X174, transcriptional factors also contain domains that bind DNA and therefore may be useful as nucleic aid condensing agents. Briefly, transcriptional factors such as C/CEBP, c-jun, c-fos, AP-1, AP-2, AP-3, CPF, Prot-1, Sp-1, Oct-1, Oct-2, CREP, and TFIID contain basic domains that bind DNA sequences.

Organic polycationic agents include: spermine, spermidine, and purtrescine.

The dimensions and of the physical properties of a polycationic agent can be extrapolated from the list above, to construct other polypeptide polycationic agents or to produce synthetic polycationic agents.

Synthetic polycationic agents which are useful include, for example, DEAE-dextran, polybrene. Lipofectin™, and lipofectAMINE™ are monomers that form polycationic complexes when combined with polynucleotides/polypeptides.

Immunodiagnostic Assays

Neisserial antigens of the invention can be used in immunoassays to detect antibody levels (or, conversely, anti-Neisserial antibodies can be used to detect antigen levels). Immunoassays based on well defined, recombinant antigens can be developed to replace invasive diagnostics methods. Antibodies to Neisserial proteins within biological samples, including for example, blood or serum samples, can be detected. Design of the immunoassays is subject to a great deal of variation, and a variety of these are known in the art. Protocols for the immunoassay may be based, for example, upon competition, or direct reaction, or sandwich type assays. Protocols may also, for example, use solid supports, or may be by immunoprecipitation. Most assays involve the use of labeled antibody or polypeptide; the labels may be, for example, fluorescent, chemiluminescent, radioactive, or dye molecules. Assays which amplify the signals from the probe are also known; examples of which are assays which utilize biotin and avidin, and enzyme-labeled and mediated immunoassays, such as ELISA assays.

Kits suitable for immunodiagnosis and containing the appropriate labeled reagents are constructed by packaging the appropriate materials, including the compositions of the invention, in suitable containers, along with the remaining reagents and materials (for example, suitable buffers, salt solutions, etc.) required for the conduct of the assay, as well as suitable set of assay instructions.

Nucleic Acid Hybridisation

"Hybridization" refers to the association of two nucleic acid sequences to one another by hydrogen bonding. Typically, one sequence will be fixed to a solid support and the other will be free in solution. Then, the two sequences will be placed in contact with one another under conditions that favor hydrogen bonding. Factors that affect this bonding include: the type and volume of solvent; reaction temperature; time of hybridization; agitation; agents to block the non-specific attachment of the liquid phase sequence to the solid support (Denhardt's reagent or BLOTTO); concentration of the sequences; use of compounds to increase the rate of association of sequences (dextran sulfate or polyethylene glycol); and the stringency of the washing conditions following hybridization. See Sambrook et al. [supra] Volume 2, chapter 9, pages 9.47 to 9.57.

"Stringency" refers to conditions in a hybridization reaction that favor association of very similar sequences over sequences that differ. For example, the combination of temperature and salt concentration should be chosen that is approximately 120 to 200° C. below the calculated Tm of the hybrid under study. The temperature and salt conditions can often be determined empirically in preliminary experiments in which samples of genomic DNA immobilized on filters are hybridized to the sequence of interest and then washed under conditions of different stringencies. See Sambrook et al. at page 9.50.

Variables to consider when performing, for example, a Southern blot are (1) the complexity of the DNA being blotted and (2) the homology between the probe and the sequences being detected. The total amount of the fragment(s) to be studied can vary a magnitude of 10, from 0.1 to 1 µg for a plasmid or phage digest to $10^{-9}$ to $10^{-8}$ g for a single copy gene in a highly complex eukaryotic genome. For lower complexity polynucleotides, substantially shorter blotting, hybridization, and exposure times, a smaller amount of starting polynucleotides, and lower specific activity of probes can be used. For example, a single-copy yeast gene can be detected with an exposure time of only 1 hour starting with 1 µg of yeast DNA, blotting for two hours, and hybridizing for 4–8 hours with a probe of $10^8$ cpm/µg. For a single-copy mammalian gene a conservative approach would start with 10 µg of DNA, blot overnight, and hybridize overnight in the presence of 10% dextran sulfate using a probe of greater than $10^8$ cpm/µg, resulting in an exposure time of ~24 hours.

Several factors can affect the melting temperature (Tm) of a DNA—DNA hybrid between the probe and the fragment of interest, and consequently, the appropriate conditions for hybridization and washing. In many cases the probe is not 100% homologous to the fragment. Other commonly encountered variables include the length and total G+C content of the hybridizing sequences and the ionic strength and formamide content of the hybridization buffer. The effects of all of these factors can be approximated by a single equation:

$$Tm = 81 + 16.6(\log_{10} Ci) + 0.4[\%(G+C)] - 0.6(\%\text{formamide}) - 600/n - 1.5(\%\text{mismatch}).$$

where Ci is the salt concentration (monovalent ions) and n is the length of the hybrid in base pairs (slightly modified from Meinkoth & Wahl (1984) *Anal. Biochem.* 138:267–284):

In designing a hybridization experiment, some factors affecting nucleic acid hybridization can be conveniently altered. The temperature of the hybridization and washes and the salt concentration during the washes are the simplest to adjust. As the temperature of the hybridization increases (ie. stringency), it becomes less likely for hybridization to occur between strands that are nonhomologous, and as a result, background decreases. If the radiolabeled probe is not completely homologous with the immobilized fragment (as is frequently the case in gene family and interspecies hybridization experiments), the hybridization temperature must be reduced, and background will increase. The temperature of the washes affects the intensity of the hybridizing band and the degree of background in a similar manner. The stringency of the washes is also increased with decreasing salt concentrations.

In general, convenient hybridization temperatures in the presence of 50% formamide are 42° C. for a probe with is 95% to 100% homologous to the target fragment, 37° C. for 90% to 95% homology, and 32° C. for 85% to 90% homology. For lower homologies, formamide content should be lowered and temperature adjusted accordingly, using the equation above. If the homology between the probe and the target fragment are not known, the simplest approach is to start with both hybridization and wash conditions which are nonstringent. If non-specific bands or high background are observed after autoradiography, the filter can be washed at high stringency and reexposed. If the time required for exposure makes this approach impractical, several hybridization and/or washing stringencies should be tested in parallel.

BRIEF DESCRIPTION OF THE DRAWINGS

FIGS. 1A–1D to 7A–7D show BOXSHADE-rendered alignments of (1) ORF40 (SEQ ID NOS:1–21) (2) ORF4 (SEQ ID NOS:22–53) (3) 225 (SEQ ID NOS:54–87) (4) 235 (SEQ ID NOS:88–118) (5) 287 (SEQ ID NOS:119–124) (6) 519 (SEQ ID NOS:125–146) (7) 919 (SEQ ID NOS:147–181). Conserved amino acids have a solid background.

FIG. 8 shows a phylogenetic tree.

MNKIYRIIWNSALNAWV (SEQ ID NO:204)

VSELTRNHTKRASATV (SEQ ID NO:205)

TAVLATLL (SEQ ID NO:206)

TLKAGDNLKIKQ (SEQ ID NO:207)

FTYSLKKDLTDLTSV (SEQ ID NO:208)

TEKLSFGANG (SEQ ID NO:209)

KVNITSDTKGLNFAKETAGTNGD (SED ID NO:210)

TVHLNGIGSTLTDTL (SEQ ID NO:211)

RAAS (V/I) KDVLNAGWNIKGVK (SEQ ID NO:212)

Figure 9A:
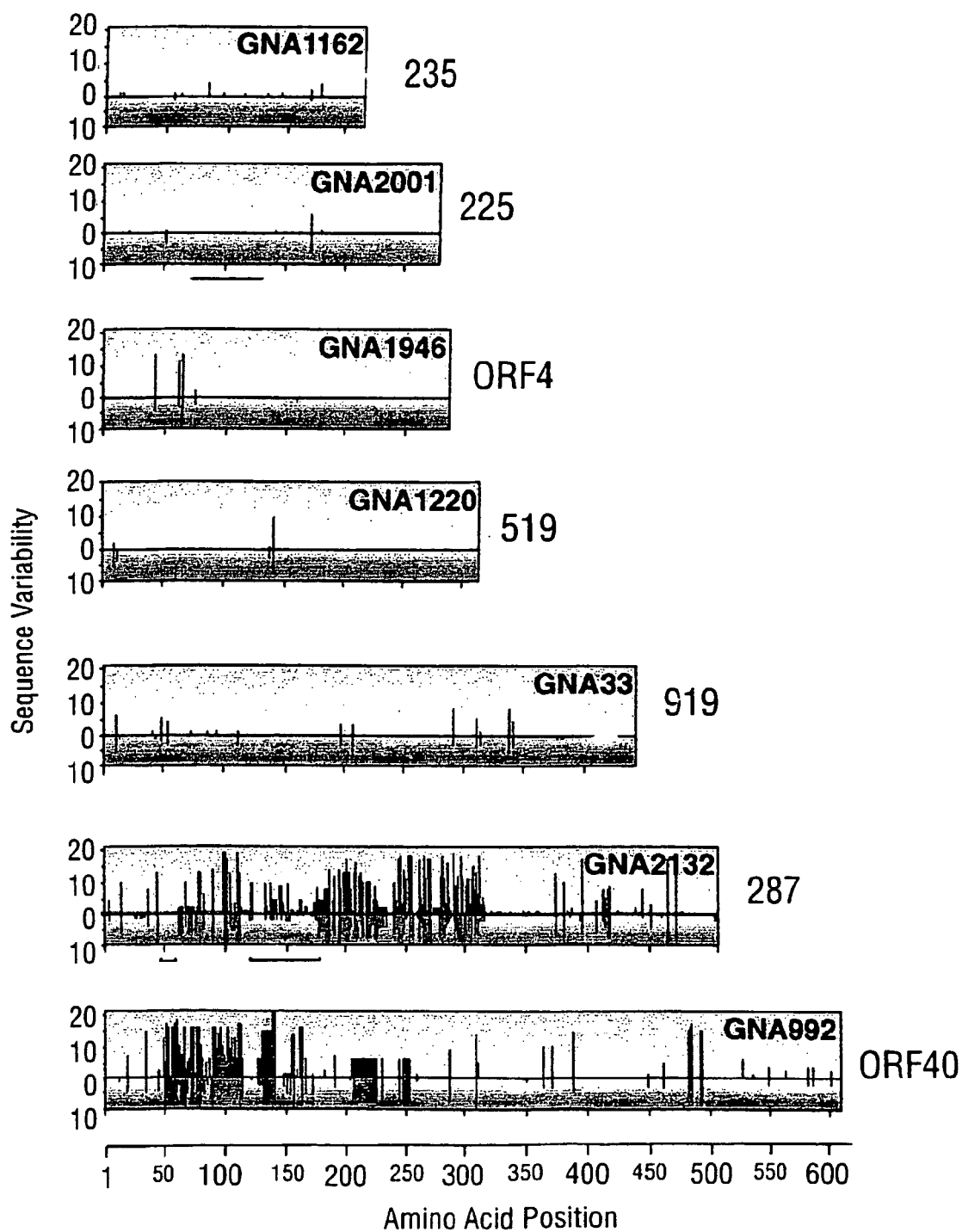
FIG. 9A illustrates amino acid sequence variability within *N. meningitidis* for ORF4, ORF40, 225, 235, 287, 519, and 919. These sequences were used to construct the ph Conserved regions of particular interest are.
Figure 9B:
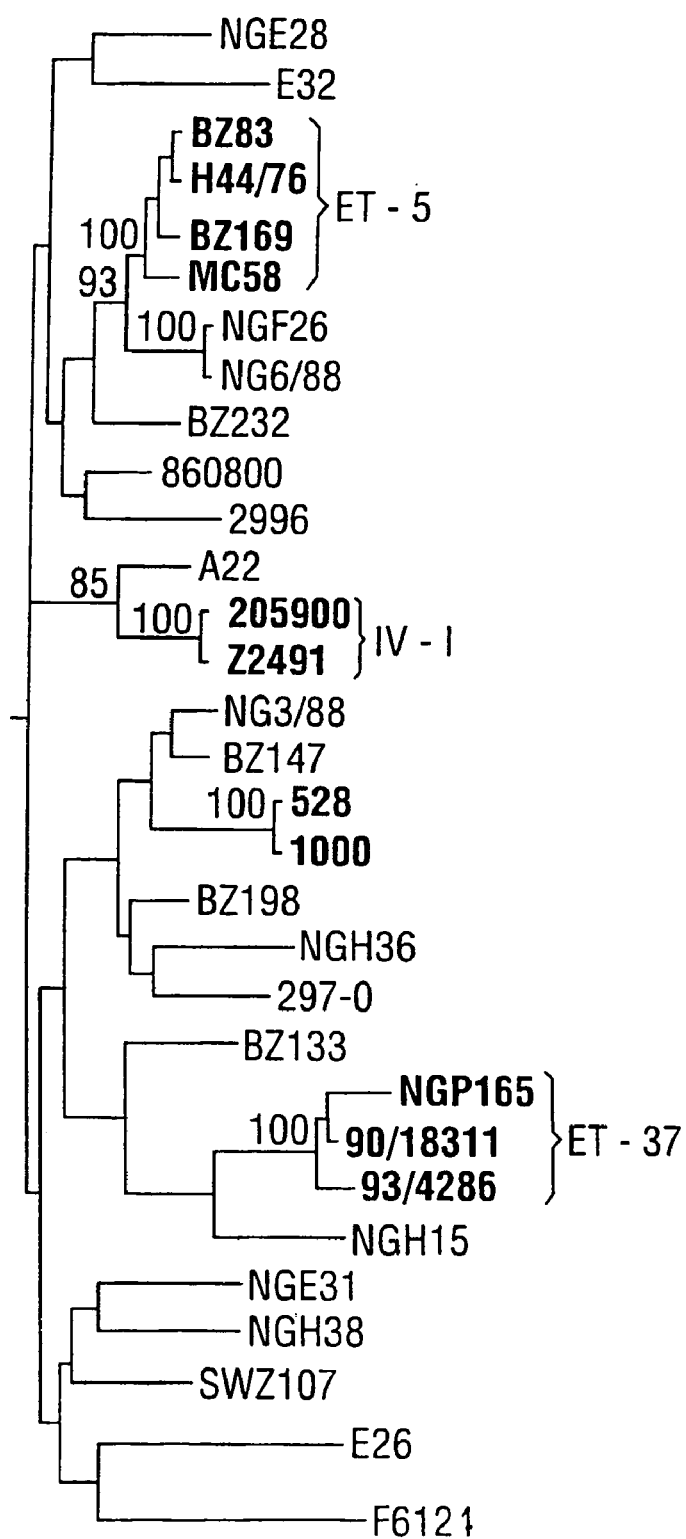

NVDFVRTYDTVEFLSADTKTTTVNVESKDNGKKTEVKIGAKTSVIKEKDGKLVTGK
(SEQ ID NO:213)

KGENGSSTDEGEGLVTAKEVIDAVNKAGWRMKTTTANGQTGQADKFETVTSGT (SEQ ID NO:214)

GTTATVSKDDQGNITV (SEQ ID NO:215)

YDVNVGDALNVNQLQNSGWNLDSKAVAGSSGKVISGNVSPSKGKMDETVNINAGNNIEI
TRNGKNIDIATSM (SEQ ID NO:216)

PQFSSVSLGAGADAPTLSVD (SEQ ID NO:217)

NKPVRITNVAPGKEGDVTNVAQLKGVAQNLNNRIDNVDGNARAGIAQAIATAGLVQAYL
PGKSMMAIGGGTYRGEAGYAIGYSSISDGGNWIIKGTASGNSRGHFGASASVGYQW
(SEQ ID NO:218).

Example 2

Example 26 of WO99/24578 discloses the cloning and expression of a Neisserial protein referred to as "ORF4". Protein and DNA sequences from serogroup A and B *N. meningitidis* are disclosed, along with sequences from *N. gonorrhoeae*. The identity between the sequences at an amino acid level are:

|  | *N.meningitidis* A | *N.gonorrhoeae* |
|---|---|---|
| *N.meningitidis* B | 99.7% over 287 aa | 97.6% over 288 aa |

ORF4 was sequenced for a reference population of 32 strains of *Neisseria*:

| Identification number | Strain | Reference |
|---|---|---|
| Group B | | |
| zv01_4 (SEQ ID NO: 46) | NG6/88 | Seiler et al. (1996) |
| zv02_4 (SEQ ID NO: 25) | BZ198 | Seiler et al. (1996) |
| zv03_4ass (SEQ ID NO: 27) | NG3/88 | Seiler et al. (1996) |
| zv04_4 (SEQ ID NO: 28) | 297-0 | Seiler et al. (1996) |
| zv05_4 (SEQ ID NO: 29) | 1000 | Seiler et al. (1996) |
| zv06_4 (SEQ ID NO: 40) | BZ147 | Seiler et al. (1996) |
| zv07_4 (SEQ ID NO: 47) | BZ169 | Seiler et al. (1996) |
| zv08_4 (SEQ ID NO: 35) | 528 | Seiler et al. (1996) |
| zv09_4 (SEQ ID NO: 30) | NGP165 | Seiler et al. (1996) |
| zv10_4 (SEQ ID NO: 36) | BZ133 | Seiler et al. (1996) |
| zv11_4 (SEQ ID NO: 49) | NGE31 | Seiler et al. (1996) |
| zv12_4ass (SEQ ID NO: 52) | NGF26 | Seiler et al. (1996) |
| zv13_4 (SEQ ID NO: 44) | NGE28 | Seiler et al. (1996) |
| zv15_4 (SEQ ID NO: 26) | SWZ107 | Seiler et al. (1996) |
| zv16_4 (SEQ ID NO: 31) | NGH15 | Seiler et al. (1996) |
| zv17_4 (SEQ ID NO: 38) | NGH36 | Seiler et al. (1996) |
| zv18_4 (SEQ ID NO: 32) | BZ232 | Seiler et al. (1996) |
| zv19_4 (SEQ ID NO: 41) | BZ83 | Seiler et al. (1996) |
| zv20_4 (SEQ ID NO: 42) | 44/76 | Seiler et al. (1996) |
| zv21_4 (SEQ ID NO: 48) | MC58 | Virji et al. (1992) |
| zv96_4 (SEQ ID NO: 39) | 2996 | Chiron SpA |
| Group A | | |
| zv22_4 (SEQ ID NO: 51) | 205900 | Chiron SpA |
| z2491_4 (SEQ ID NO: 43) | Z2491 | Maiden et al., 1998 |
| Group C | | |
| zv24_4 (SEQ ID NO: 53) | 90/18311 | Chiron SpA |
| zv25_4 (SEQ ID NO: 37) | 93/4286 | Chiron SpA |

-continued

| Identification number | Strain | Reference |
|---|---|---|
| Others | | |
| zv26_4ass (SEQ ID NO: 33) | A22 (group W) | Maiden et al. (1998) |
| zv27_4 (SEQ ID NO: 45) | E26 (group X) | Maiden et al. (1998) |
| zv28_4 (SEQ ID NO: 34) | 860800(group Y) | Maiden et al. (1998) |
| zv29_4 (SEQ ID NO: 50) | E32 (group Z) | Maiden et al. (1998) |
| *N. gonorrhoeae* | | |
| zv32_4 (SEQ ID NO: 23) | Ng F62 | Maiden et al. (1998) |
| zv33_4 (SEQ ID NO: 24) | Ng SN4 | R. Moxon |
| fa1090_4 (SEQ ID NO: 22) | FA1090 | Dempsey et al. (1991) |

An alignment of the sequences generated using PILEUP is shown in FIGS. 2A–2C. Stretches of conserved amino acids are evident. The first 34 amino acids, for instance, are conserved, although the seine at residue 26 is not present in 100% of *Neisseria*. The C-terminal of the protein consists of 228 conserved amino acids.

The conserved regions identified in this example confirm that fragments of the full-length ORF4 protein are suitable as multi-specific vaccines or diagnostic reagents.

ORF4 was re-sequenced for 35 strains in total, and the sequences were aligned. The results are shown in FIGS. 10A–10B.

Conserved regions of particular interest are:

```
MKTFFKTLSAAALALILAACGGQKDSAPAASASAAADNGA (SEQ ID NO:219)

KKEIVFGTTVGDFGDMVKE (SEQ ID NO:220)

ELEKKGYTVKLVEFTDYVRPNLALAEGELDINVFQHKPYLDDFKKEHNLDITEVFQVPTAPLGLYPGK
LKSLEEVKDGSTVSAPNDPSNFARVLVMLDELGWIKLKDGINPLTASKADIAENLKNIKIVELEAAQL
PRSRADVDFAVVNGNYAISSGMKLTEALFQEPSFAYVNWSAVKTADKDSQWLKDVTEAYNSDAFKAYA
HKRFEGYKSPAAWNEGAAK (SEQ ID NO:221)
```

Example 3

Example 16 of WO99/57280 discloses the cloning and expression of a Neisserial protein referred to as "225". Protein and DNA sequences from serogroup A and B *N. meningitidis* are disclosed, along with sequences from *N. gonorrhoeae*.

225 has now been sequenced for a reference population of 34 strains of *Neisseria*:

| Identification number | Strain | Source reference |
|---|---|---|
| Group B | | |
| zo01_225 (SEQ ID NO: 59) | NG6/88 | Seiler et al., 1996 |
| zo02_225 (SEQ ID NO: 68) | BZ198 | Seiler et al., 1996 |
| zo03_225 (SEQ ID NO: 83) | NG3/88 | Seiler et al., 1996 |
| zo04_225 (SEQ ID NO: 69) | 297-0 | Seiler et al., 1996 |
| zo05_225 (SEQ ID NO: 54) | 1000 | Seiler et al., 1996 |
| zo06_225 (SEQ ID NO: 70) | BZ147 | Seiler et al., 1996 |
| zo07_225 (SEQ ID NO: 71) | BZ169 | Seiler et al., 1996 |
| zo08_225 (SEQ ID NO: 55) | 528 | Seiler et al., 1996 |
| zo09_225 (SEQ ID NO: 60) | NGP165 | Seiler et al., 1996 |
| zo10_225 (SEQ ID NO: 72) | BZ133 | Seiler et al., 1996 |
| zo11_225 (SEQ ID NO: 57) | NGE31 | Seiler et al., 1996 |
| zo12_225 (SEQ ID NO: 61) | NGF26 | Seiler et al., 1996 |
| zo13_225 (SEQ ID NO: 82) | NGE28 | Seiler et al., 1996 |
| zo14_225 (SEQ ID NO: 73) | NGH38 | Seiler et al., 1996 |
| zo15_225 (SEQ ID NO: 84) | SWZ107 | Seiler et al., 1996 |
| zo16_225 (SEQ ID NO: 74) | NGH15 | Seiler et al., 1996 |
| zo17_225 (SEQ ID NO: 75) | NGH36 | Seiler et al., 1996 |
| zo18_225 (SEQ ID NO: 76) | BZ232 | Seiler et al., 1996 |
| zo19_225 (SEQ ID NO: 77) | BZ83 | Seiler et al., 1996 |
| zo20_225 (SEQ ID NO: 58) | 44/76 | Seiler et al., 1996 |
| zo21_225 (SEQ ID NO: 78) | MC58 | Chiron SpA |
| zo96_225 (SEQ ID NO: 67) | 2996 | Chiron SpA |

| Identification number | Strain | Source reference |
|---|---|---|
| Group A | | |
| zo22_225 (SEQ ID NO: 62) | 205900 | Chiron SpA |
| zo23_225 (SEQ ID NO: 63) | F6124 | Chiron SpA |
| z2491 (SEQ ID NO: 56) | Z2491 | Maiden et al., 1998 |
| Group C | | |
| zo24_225 (SEQ ID NO: 64) | 90/18311 | Chiron SpA |
| zo25_225 (SEQ ID NO: 65) | 93/4286 | Chiron SpA |
| Others | | |
| zo26_225 (SEQ ID NO: 66) | A22 (group W) | Maiden et al., 1998 |
| zo27_225 (SEQ ID NO: 79) | E26 (group X) | Maiden et al., 1998 |
| zo28_225 (SEQ ID NO: 80) | 860800 (group Y) | Maiden et al., 1998 |
| zo29_225 (SEQ ID NO: 81) | E32 (group Z) | Maiden et al., 1998 |

-continued

| Identification number | Strain | Source reference |
|---|---|---|
| *Gonococcus* | | |
| zo32_225 (SEQ ID NO: 86) | Ng F62 | Maiden et al., 1998 |
| zo33_225 (SEQ ID NO: 87) | Ng SN4 | Chiron SpA |
| fa1090 (SEQ ID NO: 85) | FA1090 | Chiron SpA |

An alignment of the sequences generated using PILEUP is shown in FIGS. 3A–3C. Stretches of conserved amino acids are evident. The first 74 amino acids, for instance, are conserved, although the isoleucine at residue 51 is not present in 100% of *Neisseria*. The C-terminal of the protein consists of 148 conserved amino acids. A similar alignment is shown in FIGS. 13A–13B.

The conserved regions identified in this example confirm that fragments of the full-length 225 protein are suitable as multi-specific vaccines or diagnostic reagents.

Example 4

Example 16 of WO99/57280 discloses the cloning and expression of a Neisserial protein referred to as "235". Protein and DNA sequences from serogroup A and B *N. meningitidis* are disclosed, along with sequences from *N. gonorrhoeae*.

235 has now been sequenced for a reference population of 31 strains of *Neisseria*:

| Identification number | Strain | Reference |
|---|---|---|
| Group B | | |
| gnmzq01 (SEQ ID NO: 93) | NG6/88 | Seiler et al., 1996 |
| gnmzq02 (SEQ ID NO: 96) | BZ198 | Seiler et al., 1996 |
| gnmzq03 (SEQ ID NO: 97) | NG3/88 | Seiler et al., 1996 |
| gnmzq04 (SEQ ID NO: 98) | 1000 | Seiler et al., 1996 |
| gnmzq05 (SEQ ID NO: 94) | 1000 | Seiler et al., 1996 |
| gnmzq07 (SEQ ID NO: 99) | BZ169 | Seiler et al., 1996 |
| gnmzq08 (SEQ ID NO: 95) | 528 | Seiler et al., 1996 |
| gnmzq09 (SEQ ID NO: 88) | NGP165 | Seiler et al., 1996 |
| gnmzq10 (SEQ ID NO: 100) | BZ133 | Seiler et al., 1996 |
| gnmzq11 (SEQ ID NO: 101) | NGE31 | Seiler et al., 1996 |
| gnmzq13 (SEQ ID NO: 102) | NGE28 | Seiler et al., 1996 |
| gnmzq14 (SEQ ID NO: 116) | NGH38 | Seiler et al., 1996 |
| gnmzq15 (SEQ ID NO: 103) | SWZ107 | Seiler et al., 1996 |
| gnmzq16 (SEQ ID NO: 104) | NGH15 | Seiler et al., 1996 |
| gnmzq17 (SEQ ID NO: 105) | NGH36 | Seiler et al., 1996 |
| gnmzq18 (SEQ ID NO: 117) | BZ232 | Seiler et al., 1996 |
| gnmzq19 (SEQ ID NO: 106) | BZ83 | Seiler et al., 1996 |
| gnmzq21 (SEQ ID NO: 107) | MC58 | Virji et al., 1992 |

-continued

| Identification number | Strain | Reference |
|---|---|---|
| Group A | | |
| gnmzq22 (SEQ ID NO: 108) | 205900 | Chiron SpA |
| gnmzq23 (SEQ ID NO: 109) | F6124 | Chiron SpA |
| z2491 (SEQ ID NO: 115) | Z2491 | Maiden et al., 1998 |
| Group C | | |
| gnmzq24 (SEQ ID NO: 110) | 90/18311 | Chiron SpA |
| gnmzq25 (SEQ ID NO: 111) | 93/4286 | Chiron SpA |
| Others | | |
| gnmzq26 (SEQ ID NO: 118) | A22 (group W) | Maiden et al., 1998 |
| gnmzq27 (SEQ ID NO: 112) | E26 (group X) | Maiden et al., 1998 |
| gnmzq28 (SEQ ID NO: 113) | 860800 (group Y) | Maiden et al., 1998 |
| gnmzq29 (SEQ ID NO: 114) | E32 (group Z) | Maiden et al., 1998 |
| gnmzq31 (SEQ ID NO: 89) | *N. lactamica* | Chiron SpA |
| *Gonococcus* | | |
| gnmzq32 (SEQ ID NO: 91) | Ng F62 | Maiden et al., 1998 |
| gnmzq33 (SEQ ID NO: 92) | Ng SN4 | Chiron SpA |
| fa1090 (SEQ ID NO: 90) | FA1090 | Dempsey et al. 1991 |

An alignment of the sequences generated using PILEUP is shown in FIGS. 4A–4B. Stretches of conserved amino acids are evident. The protein is wholly conserved, although the serine at residue 168 shows some variance.

The conserved regions identified in this example confirm that fragments of the full-length 235 protein are suitable as multi-specific vaccines or diagnostic reagents.

235 was re-sequenced for 35 strains in total, and the sequences were aligned. The results are shown in FIGS. 14A–14B.

Example 5

Example 16 of WO99/57280 discloses the cloning and expression of a Neisserial protein referred to as "287". Protein and DNA sequences from serogroup A and B *N. meningitidis* are disclosed, along with sequences from *N. gonorrhoeae*.

287 has now been sequenced for a reference population of 6 strains of *Neisseria*:

| Identification number | Strain | Reference |
|---|---|---|
| Group B | | |
| 287_2 (SEQ ID NO: 120) | BZ198 | Seiler et al.(1996) |
| 287_9 (SEQ ID NO: 123) | NGP165 | Seiler et al.(1996) |
| 287_14 (SEQ ID NO: 119) | NGH38 | Seiler et al.(1996) |
| 287_21 (SEQ ID NO: 121) | MC58 | Virji et al.(1992) |
| Group A | | |
| z2491 (SEQ ID NO: 122) | Z2491 | Maiden et al.(1998) |

| Identification number | Strain | Reference |
|---|---|---|
| *Gonococcus* | | |
| fa1090 (SEQ ID NO: 124) | FA1090 | Dempsey et al.(1991) |

An alignment of the sequences generated using PILEUP is shown in FIG. 5. Stretches of conserved amino acids are evident. The first 42 amino acids, for instance, are well conserved and a long conserved region can be seen at the C-terminus.

The conserved regions identified in this example confirm that fragments of the full-length 287 protein are suitable as multi-specific vaccines or diagnostic reagents.

287 was re-sequenced for 35 strains in total (including Cl 1, a serogroup C *N. meningitidis* strain), and the sequences were aligned. The results are shown in FIGS. 15A–15E.

Conserved regions of particular interest are:

MFKRSVIAMACI (SEQ ID NO:222)

ALSACGGGGGSPDVKSADT (SEQ ID NO:223)

SKPAAPVV (SEQ ID NO:224)

QDMAAVS (SEQ ID NO:225)

ENTGNGGAATTD (SEQ ID NO:226)

QNDMPQ (SEQ ID NO:254)

DGPSQNITLTHCK (SEQ ID NO:227)

KSEFE (SEQ ID NO:255)

RRSARSRRSLPAEMPLIPVNQADTLIVDGEAVSLTGHSGNIFAPEGNYRYLTYGAEKL (SEQ ID NO:228)

GGSYAL (SEQ ID NO:256)

VQGEPAKGEMLAGTAVYNGEVLHFH (SEQ ID NO:229)

GRFAAKVDFGSKSVDGIIDSGDDLHMG (SEQ ID NO:230)

QKFKAAIDGNGFKGTWTENGGGDVSG (R/K) FYGPAGEEVAGKYSYRPTDAEKGGFGVFAGKKDRD (SEQ ID NO:231)

Example 6

Example 16 of WO99/57280 discloses the cloning and expression of a Neisserial protein referred to as "519". Protein and DNA sequences from serogroup A and B *N. meningitidis* are disclosed, along with sequences from *N. gonorrhoeae*.

519 has now been sequenced for a reference population of 22 strains of *Neisseria*:

| Identification number | Strain | Source |
|---|---|---|
| Group B | | |
| zv01_519 (SEQ ID NO: 137) | NG6/88 | Seiler et al., 1996 |
| zv02_519 (SEQ ID NO: 133) | BZ198 | Seiler et al., 1996 |
| zv03_519ass (SEQ ID NO: 134) | NG3/88 | Seiler et al., 1996 |
| zv04_519 (SEQ ID NO: 135) | 297-0 | Seiler et al., 1996 |
| zv05_519 (SEQ ID NO: 136) | 1000 | Seiler et al., 1996 |
| zv06_519ass (SEQ ID NO: 145) | BZ147 | Seiler et al., 1996 |
| zv07_519 (SEQ ID NO: 138) | BZ169 | Seiler et al., 1996 |
| zv11_519 (SEQ ID NO: 130) | NGE31 | Seiler et al., 1996 |
| zv12_519 (SEQ ID NO: 139) | NGF26 | Seiler et al., 1996 |
| zv18_519 (SEQ ID NO: 140) | BZ232 | Seiler et al., 1996 |
| zv19_519 (SEQ ID NO: 141) | BZ83 | Seiler et al., 1996 |
| zv20_519ass (SEQ ID NO: 144) | 44/76 | Seiler et al., 1996 |
| zv21_519ass (SEQ ID NO: 142) | MC58 | Chiron SpA |
| zv96_519 (SEQ ID NO: 132) | 2996 | Chiron SpA |
| Group A | | |
| zv22_519ass (SEQ ID NO: 127) | 205900 | Chiron SpA |
| z2491_519 (SEQ ID NO: 125) | Z2491 | Maiden et al., 1998 |
| Others | | |
| zv26_519 (SEQ ID NO: 126) | A22 (group W) | Maiden et al., 1998 |
| zv27_519 (SEQ ID NO: 143) | E26 (group X) | Maiden et al., 1998 |
| zv28_519 (SEQ ID NO: 131) | 860800 (group Y) | Maiden et al., 1998 |
| zv29_519ass (SEQ ID NO: 146) | E32 (group Z) | Maiden et al., 1998 |
| *Gonococcus* | | |
| zv32_519 (SEQ ID NO: 129) | Ng F62 | Maiden et al., 1998 |

| Identification number | Strain | Source |
|---|---|---|
| fa1090_519 (SEQ ID NO: 128) | FA1090 | Chiron SpA |

An alignment of the sequences generated using PILEUP is shown in FIGS. 6A–6B. Stretches of conserved amino acids are evident, and the protein shows conservation along its complete length.

The conserved regions identified in this example confirm that fragments of the full-length 519 protein are suitable as multi-specific vaccines or diagnostic reagents.

519 was re-sequenced for 33 strains in total, and the sequences were aligned. The results are shown in FIGS. 16A–16B.

Conserved regions of particular interest are:

```
MEFFIILL (SEQ ID NO:232)

AVAVFGFKSFVVIPQQEVHVVERLGRFHRALTAGLNILIPFIDRVAYRHSLKEIPLDVPSQVCITRDN
TQLTVDGIIYFQVTDPKLASYGSSNYIMAITQLAQTTLRSVIGRMELDKTFEERDEINSTVV
(SEQ ID NO:233)

ALDEAAGAWGVKVLRYEIKDLVPPQEILRSMQAQITAEREKRARIAESEGRKIEQINLASGQREAEIQ
QSEGEAQAAVNASNAEKIARINRAKGEAESLRLVAEANAEANRQIAAALQTQSGADAVNLKIAGQYVT
AFKNLAKEDNTRIKPAKVAEIGNPNFRRHEKFSPEAKTAK (SEQ ID NO:234)
```

Example 7

Example 16 of WO99/57280 discloses the cloning and expression of a Neisserial protein referred to as "919". Protein and DNA sequences from serogroup A and B *N. meningitidis* are disclosed, along with sequences from *N. gonorrhoeae*.

919 has now been sequenced for a reference population of 35 strains of *Neisseria*:

| Identification number | Strains | Source |
|---|---|---|
| Group B | | |
| zm01 (SEQ ID NO: 161) | NG6/88 | Seiler et al., 1996 |
| zm02 (SEQ ID NO: 162) | BZ198 | Seiler et al., 1996 |
| zm03 (SEQ ID NO: 163) | NG3/88 | Seiler et al., 1996 |
| zm04 (SEQ ID NO: 157) | 297-0 | Seiler et al., 1996 |
| zm05 (SEQ ID NO: 173) | 1000 | Seiler et al., 1996 |
| zm06 (SEQ ID NO: 170) | BZ147 | Seiler et al., 1996 |
| zm07 (SEQ ID NO: 164) | BZ169 | Seiler et al., 1996 |
| zm08n (SEQ ID NO: 159) | 528 | Seiler et al., 1996 |
| zm09 (SEQ ID NO: 152) | NGP165 | Seiler et al., 1996 |
| zm10 (SEQ ID NO: 153) | BZ133 | Seiler et al., 1996 |
| zm11asbc (SEQ ID NO: 158) | NGE31 | Seiler et al., 1996 |
| zm12 (SEQ ID NO: 165) | NGF26 | Seiler et al., 1996 |
| zm13 (SEQ ID NO: 172) | NGE28 | Seiler et al., 1996 |
| zm14 (SEQ ID NO: 156) | NGH38 | Seiler et al., 1996 |
| zm15 (SEQ ID NO: 180) | SWZ107 | Seiler et al., 1996 |
| zm16 (SEQ ID NO: 179) | NGH15 | Seiler et al., 1996 |
| zm17 (SEQ ID NO: 171) | NGH36 | Seiler et al., 1996 |
| zm18 (SEQ ID NO: 166) | BZ232 | Seiler et al., 1996 |
| zm19 (SEQ ID NO: 167) | BZ83 | Seiler et al., 1996 |
| zm20 (SEQ ID NO: 168) | 44/76 | Seiler et al., 1996 |
| zm21 (SEQ ID NO: 169) | MC58 | Chiron SpA |
| zm96 (SEQ ID NO: 160) | 2996 | Chiron SpA |
| Group A | | |
| zm22 (SEQ ID NO: 175) | 205900 | Chiron SpA |
| zm23asbc (SEQ ID NO: 150) | F6124 | Chiron SpA |
| z2491 (SEQ ID NO: 174) | Z2491 | Maiden et al., 1998 |
| Group C | | |
| zm24 (SEQ ID NO: 154) | 90/18311 | Chiron SpA |
| zm25 (SEQ ID NO: 155) | 93/4286 | Chiron SpA |
| Others | | |
| zm26 (SEQ ID NO: 176) | A22 (group W) | Maiden et al., 1998 |
| zm27bc (SEQ ID NO: 151) | E26 (group X) | Maiden et al., 1998 |
| zm28 (SEQ ID NO: 177) | 860800 (group Y) | Maiden et al., 1998 |
| zm29asbc (SEQ ID NO: 178) | E32 (group Z) | Maiden et al., 1998 |
| zm31asbc (SEQ ID NO: 181) | *N. lactamica* | Chiron SpA |
| *Gonococcus* | | |
| zm32asbc (SEQ ID NO: 149) | Ng F62 | Maiden et al., 1998 |
| zm33asbc (SEQ ID NO: 148) | Ng SN4 | Chiron SpA |
| fa1090 (SEQ ID NO: 147) | FA1090 | Chiron SpA |

An alignment of the sequences generated using PILEUP is shown in FIGS. 7A–7D. Another alignment is shown in FIGS. 18A–18C. Stretches of conserved amino acids are evident The protein shows almost complete conservation, The conserved regions identified in this example confirm that fragments of the full-length 919 protein are suitable as multi-specific vaccines or diagnostic reagents.

Conserved regions of particular interest are:

MKKYLFRAAL (SEQ ID NO:235)

GIAAAILAACQSKSIQTFPQPDTSVINGPDRPVGIPDPAGTTV (G/A) GGGAVYTVVPHLSLPHWAAQ
DFAKSLQSFRLGCANLKNRQGWQDVCAQAFQTPVHSFQAKQFFERYFTPWQVAGNGSLAGTVTGYYEPVL
KGDDRRTAQARFPIYGIPDDFISVPLPAGLRSGKALVRIRQTGKNSGTIDN (SEQ ID NO:236)

GGTHTADLS (SEQ ID NO:237)

FPITARTTAIKGRFEGSRFLPYHTRNQINGGALDGKAPILGYAEDPVELFFMHIQGSGRLKTPSGKYIRI
GYADKNEHPYVSIG (R/K) YMADKGYLKLGQTSMQGIR (SEQ ID NO:238)

YMRQNPQRLAEVLGQNPSYIFFREL (SEQ ID NO:239)

NDGPVGALGTPLMGEYAGAVDRHYITLGAPLFVATAHPVTRKALNRLIMAQDTGSAIKGAVRVDYFWG
YGDEAGELAGKQKTTGYVWQLLPNGMKPEYRP (SEQ ID NO:240)

Example 8

Example 55 of WO99/23578 discloses the cloning and expression of a Neisserial protein referred to as "ORF46". Protein and DNA sequences from serogroups A and B *N. meningitidis* are disclosed, along with sequences from *N. gonorrhoeae*.

An alignment of these sequences is shown in FIGS. 12A–12B, from which stretches of conserved amino acids are evident.

Conserved regions of particular interest are:

RKISLILSILAVCLPMHAHASDLANDSFIRQVLDRQHFEPDGKYHLFGSRGELAERSGHIGLG
(SEQ ID NO:241)

IQSHQLGNLMIQQAAIKGNIGYIVRFSDHGHEVHSPFDNHASHSDSDEAGSPVDGFSLYRIHWDGYEH
HPADGYDGPQGGGYPAPKGARDIYSYDIKGVAQNIRLNLTDNRSTGQRLADRFHNAG
(SEQ ID NO:242)

MLTQGVGDGFKRATRYSPELDRSGNAAEAFNGTADIVKNIIGAAGEIVGAGDAVQGISEGSNIAVMHG
LGLLSTENKMARINDLADMAQLKDYAAAAIRDWAVQNPNAAQGIEAVSNIF (SEQ ID NO:243)

IPIKGIGAVRGKYGLGGITAHP (V/I) KRSQMGEIALPKGKSAVS (SEQ ID NO:244)

NFADAAYAKYPSPYHSRNIRSNLEQRYGKENITSSTVPPSNGKNVKLANKRHPKTKVPFDGKGFPNFE
KDVKY (SEQ ID NO:245)

The conserved regions in ORF46 confirm that fragments of this protein are suitable as multi-specific vaccines or diagnostic reagents.

Example 9

WO99/57280 discloses the cloning and expression of a Neisserial protein referred to as "726". Protein and DNA sequences from serogroups A and B *N. meningitidis* are disclosed.

726 has been sequenced for a reference population of 7 *N. meningitidis* strains in serogroups A, B and C. An alignment of these sequences is shown in FIG. 17, from which stretches of conserved amino acids are evident.

Conserved regions of particular interest are:

IYFKNGFYDDTLG (SEQ ID NO:246)

IPEGAVAVRAEEYAALLAGQAQGGQIAADSDGRPVLTPPRPS (D/E) YHEWDGKKW
(SEQ ID NO:247)

AAAAARFAEQKTATAFRLA (SEQ ID NO:248)

KADELKNSLLAGYPQVEIDSFYRQEKEALARQADNNAPTPMLAQIAAARGVELDVLIEKV (I/V) EKS
ARLAVAAGAIIGKRQQLEDKLN (SEQ ID NO:249)

IETAPGLDALEKEIEEWT (SEQ ID NO:250)

The conserved regions in 726 confirm that fragments of this protein are suitable as multi-specific vaccines or diagnostic reagents.

Example 10

WO99/57280 discloses the cloning and expression of a Neisserial protein referred to as "953". Protein and DNA sequences from serogroups A and B *N. meningitidis* are disclosed, along with sequences from *N. gonorrhoeae*.

953 has been sequenced for a reference population of 8 strains of *N. meningitidis* serogroups A, B and C. An alignment of these sequences is shown in FIG. 19, from which stretches of conserved amino acids are evident. The protein is well-conserved.

Conserved regions of particular interest are:

```
MKKIIFAALAAAAVGTASAATYKVDEYHANARFAIDHFNTSTNVGGFYGLTGSVEFDQAKRDGKIDIT
IP (I/V) ANLQSGSQHFTDHLKSADIFDAAQYPDIRFVSTKFNFNGKKLVSVDGNLTMHGKTAPVKLK
AEKFNCYQSPM (SEQ ID NO:251)

ATYKVDEYHANARFAIDHFNTSTNVGGFYGLTGSVEFDQAKRDGKIDITIP (I/V) ANLQSGSQHFTD
HLKSADIFDAAQYPDIRFVSTKFNFNGKKLVSVDGNLTMHGKTAPVKLKAEKFNCYQSPM
(SEQ ID NO:252)

KTEVCGGDFSTTIDRTKWG (M/V) DYLVNVGMTKSVRIDIQIEAAKQ (SEQ ID NO:253)
```

The conserved regions in 953 confirm that fragments of this protein are suitable as multi-specific vaccines or diagnostic reagents.

Phylogenetic Tree

FIG. 8 is a dendrogram showing the genetic relationship among 107 *N. meningitidis* strains, based on MLST analysis of six gene fragments [adapted from Maiden et al. (1998) *PNAS USA* 95:3140]. The dendrogram can be used to select strains representative of meningococcus serogroup B (arrows). Five additional strains, for which genetic assignment to hypervirulent lineages has been independently determined by Wang et al. [*J. Infect. Dis* (1993) 167:1320], Seiler et al. [*Mol. Microbiol*. (1996) 19:841], and Virji et al. [*Mol. Microbiol*. (1992) 6:1271] are superimposed on the dendrogram and indicated by asterisks. In addition to the 22 strains of MenB, three strains of MenA, two strains of MenC, and one strain each of Men Y, X, Z and W135 were used. These are indicated by bold letters before the name. Where phylogenetic data were not available, the strains are shown outside the tree. The hypervirulent strains ET-5, ET-37 and IV-1 are indicated.

Sequence Variability

FIG. 9*a* is a schematic representation of amino acid sequence variability with *N. meningitidis* for proteins 225, 235, 287, 519, 919, ORF4 and ORF40. The horizontal axis represents the sequence of MC58. Amino acid differences within MenB strains are indicated by vertical lines above the horizontal axis; differences within serogroups A, C, Y, X, Z and W135 are indicated by lines below the axis. The height of the vertical lines represents the number of strains with amino acid differences. Peaks thus show variable regions. The bard below 225 and 287 represent sequence segments that are missing from some strains.

FIG. 9*b* is a dendrogram of *N. Meningitidis* strains obtained using the same 7 proteins. The phylogenetic analysis based on these genes provided a dendrogram which clusters the hypervirulent strains in agreement with FIG. 8. Bars indicate strains which cluster with 100% bootstrap support in agreement MLST analysis. Numbers at the base of each node are bootstrap scores (only those >80% are reported). Gene sequences from different strains were aligned with the program PILEUP from the GCG package. The phylogenetic analysis was performed using the neighbour-joining algorithm [Saitou & Nei (1987) *Mol. Biol. Evol.* 4:406] as implemented in the NEIGHBOR program of the PHYLIP package. Pairwise distances were calculated using the Kimura-two parameter [Kimura (1980) *J. Mol. Evol.* 16:111] on the 31 *N. meningitidis* strains. The N-terminal region of ORF40, the entire 287, and the tandem repeats of 225 were excluded from the analysis. A total of 1000 bootstrap replicates were allowed to evaluate the level of support. The clustering of the hypervirulent strains was confirmed by maximum parsimony analysis.

Western blots

Western blots Antigens ORF4, 225, 235, 519 and 919 we analysed by Western blot for various stains. The results are shown in FIGS. 20A–20E. In the case of 225, the blot shows fragments of different sizes in the different strains, with arrows indicating the band of correct size. 225 contains regions of deletion and insertion of a defined repeat and the size of the fragments on the blots matches the gene variability data.

The strains used for FIGS. 20A–20E are as follows:

*N. meningitidis* serogroup B:

| | | | | |
|---|---|---|---|---|
| 1 = NG6/88 | 2 = BZ198 | 3 = NG3/88 | 4 = 297-0 | 5 = 1000 |
| 6 = BZ147 | 7 = BZ169 | 8 = 528 | 9 = | 10 = BZ133 |
| 11 = NGE31 | 12 = NGF26 | 13 = NGE28 | NGP165 | 15 = SWZ107 |
| 16 = NGH15 | 17 = NGH36 | 18 = BZ232 | 14 = NGH38 | 20 = 44/76 |
| 21 = MC58 | 96 = 2996 | | 19 = BZ83 | |

*N. meningitidis* serogroup A:

22 = 205900 23 = F6124

*N. meningitidis* serogroup C:

24 = 90/18311 25 = 93/4286

Other *N. meningitidis*

26 = A22 (serogroup W)
27 = E26 (serogroup X)
28 = 860800 (serogroup Y)
29 = E32 (serogroup Z)

Other *Neisseria*

30 = *N. cinerea*
L17 = *N.lactamica*
L19 = *N.lactamica*
31 = *N. gonorrhoeae* F62
32 = *N.gonorrhoeae* SN4

It will be appreciated that the invention has been described by means of example only, and that modifications may be made whilst remaining within the spirit and scope of the invention.

SEQUENCE LISTING (256 sequences)

SEQ ID NO: 1 - protein, 591 aa, Neisseria meningitidis
MNKIYRIIWNSALNAWVVVSELTRNHTKRASATVKTAVLATLLFATVQASANNEEQEEDLYLDPVQRTVAVLIVNSDKEGTGEKEKVEENSDWAVYFNEKGVLTAREITLKAGDNLKIKQNGTNFTYSLKKDLTDLTSVGTEKLSFSANGNKVNITSDTKGLNFAKETAGTNGDTTVHLNGIGSTLTDTLLNTGATTNVTNDNVTDDEKKRAASVKDVLNAGWNIKGVKPGTTASDNVDFVRTYDTVEFLSADTKTTTVNVESKDNGKKTEVKIGAKTSVIKEKDGKLVTGKDKGENGSSTDEGEGLVTAKEVIDAVNKAGWRMKTTTANGQTGQADKFETVTSGTNVTFASGKGTTATVSKDDQGNITVMYDVNVGDALNVNQLQNSGWNLDSKAVAGSSGKVISGNVSPSKGKMDETVNINAGNNIEITRNGKNIDIATSMTPQFSSVSLGAGADAPTLSVDGDALNVGSKKDNKPVRITNVAPGVKEGDVTNVAQLKGVAQNLNNRIDNVDGNARAGIAQAIATAGLVQAYLPGKSMMAIGGGTYRGEAGYAIGYSSISDGGNWIIKGTASGNSRGHFGASASVGYQW

SEQ ID NO: 2 - protein, 591 aa, Neisseria meningitidis; identical to SEQ ID NO: 1

SEQ ID NO: 3 - protein, 591 aa, Neisseria meningitidis; identical to SEQ ID NO: 1

SEQ ID NO: 4 - protein, 591 aa, Neisseria meningitidis
MNKIYRIIWNSALNAWVVVSELTRNHTKRASATVETAVLATLLFATVQASANNEEQEEDLYLDPVQRTVAVLIVNSDKEGTGEKEKVEENSDWAVYFNEKGVLTAREITLKAGDNLKIKQNGTNFTYSLKKDLTDLTSVGTEKLSFSANGNKVNITSDTKGLNFAKETAGTNGDTTVHLNGIGSTLTDTLLNTGATTNVTNDNVTDDEKKRAASVKDVLNAGWNIKGVKPGTTASDNVDFVRTYDTVEFLSADTKTTTVNVESKDNGKKTEVKIGAKTSVIKEKDGKLVTGKDKGENGSSTDEGEGLVTAKEVIDAVNKAGWRMKTTTANGQTGQADKFETVTSGTNVTFASGKGTTATVSKDDQGNITVMYDVNVGDALNVNQLQNSGWNLDSKAVAGSSGKVISGNVSPSKGKMDETVNINAGNNIEITRNGKNIDIATSMTPQFSSVSLGAGADAPTLSVDGDALNVGSKKDNKPVRITNVAPGVKEGDVTNVAQLKGVAQNLNNRIDNVDGNARAGIAQAIATAGLVQAYLPGKSMMAIGGGTYRGEAGYAIGYSSISDGGNWIIKGTASGNSRGHFGASASVGYQW

SEQ ID NO: 5 - protein, 591 aa, Neisseria meningitidis; identical to SEQ ID NO: 1

SEQ ID NO: 6 - protein, 594 aa, Neisseria meningitidis
MNKIYRIIWNSALNAWVAVSELTRNHTKRASATVATAVLATLLFATVQASTTDDDDLYLEPVQRTAPVLSFHADSEGTGEKEVTEDSNWGVYFDKKGVLTAGTITLKAGDNLKIKQNTDENTNASSFTYSLKKDLTDLTSVETEKLSFGANGKKVNITSDTKGLNFAKETAGTNGDTTVHLNGIGSTLTDTLLNTGATTNVTNDNVTDDEKKRAASVKDVLNAGWNIKGVKPGTTASDNVDFVRTYDTVEFLSADTKTTTVNVESKDNGKKTEVKIGAKTSVIKEKDGKLVTGKDKGENGSSTDEGEGLVTAKEVIDAVNKAGWRMKTTTANGQTGQADKFETVTSGTKVTFASGNGTTATVSKDDQGNITVKYDVNVGDALNVNQLQNSGWNLDSKAVAGSSGKVISGNVSPSKGKMDETVNINAGNNIEITRNGKNIDIATSMTPQFSSVSLGAGADAPTLSVDDEGALNVGSKDANKPVRITNVAPGVKEGDVTNVAQLKGVAQNLNNHIDNVDGNARAGIAQAIATAGLVQAYLPGKSMMAIGGGTYRGEAGYAIGYSSISDGGNWIIKGTASGNSRGHFGASASVGYQW

SEQ ID NO: 7 - protein, 594 aa, Neisseria meningitidis; identical to SEQ ID NO: 6

SEQ ID NO: 8 - protein, 594 aa, Neisseria meningitidis
MNKIYRIIWNSALNAWVVVSELTRNHTKRASATVATAVLATLLFATVQASTTDDDDLYLEPVQRTAPVLSFHADSEGTGEKEVTEDSNWGVYFDKKGVLTAGTITLKAGDNLKIKQNTDENTNASSFTYSLKKDLTDLTSVETEKLSFGANGKKVNITSDTKGLNFAKETAGTNGDTTVHLNGIGSTLTDTLLNTGATTNVTNDNVTDDEKKRAASVKDVLNAGWNIKGVKPGTTASDNVDFVRTYDTVEFLSADTKTTTVNVESKDNGKKTEVKIGAKTSVIKEKDGKLVTGKDKGENGSSTDEGEGLVTAKEVIDAVNKAGWRMKTTTANGQTGQADKFETVTSGTKVTFASGNGTTATVSKDDQGNITVKYDVNVGDALNVNQLQNSGWNLDSKAVAGSSGKVISGNVSPSKGKMDETVNINAGNNIEITRNGKNIDIATSMTPQFSSVSLGAGADAPTLSVDDEGALNVGSKDANKPVRITNVAPGVKEGDVTNVAQLKGVAQNLNNHIDNVDGNARAGIAQAIATAGLVQAYLPGKSMMAIGGGTYRGEAGYAIGYSSISDGGNWIIKGTASGNSRGHFGASASVGYQW

SEQ ID NO: 9 - protein, 594 aa, Neisseria meningitidis
MNKIYRIIWNSALNAWVVVSELTRNHTKRASATVATAVLATLLFATVQANATDDDDLYLEPVQRTAVVLSFRSDKEGTGEKEGTEDSNWAVYFDEKRVLKAGAITLKAGDNLKIKQNTNENTNDSSFTYSLKKDLTDLTSVETEKLSFGANGNKVNITSDTKGLNFAKETAGTNGDPTVHLNGIGSTLTDTLLNTGATTNVTNDNVTDDEKKRAASVKDVLNAGWNIKGVKPGTTASDNVDFVRTYDTVEFLSADTKTTTVNVESKDNGKKTEVKIGAKTSVIKEKDGKLVTGKGKDENGSSTDEGEGLVTAKEVIDAVNKAGWRMKTTTANGQTGQADKFETVTSGTNVTFASGKGTTATVSKDDQGNITVKYDVNVGDALNVNQLQNSGWNLDSKAVAGSSGKVISGNVSPSKGKMDETVNINAGNNIEITRNGKNIDIATSMAPQFSSVSLGAGADAPTLSVDDEGALNVGSKDTNKPVRITNVAPGVKEGDVTNVAQLKGVAQNLNNRIDNVDGNARAGIAQAIATAGLVQAYLPGKSMMAIGGDTYRGEAGYAIGYSSISDGGNWIIKGTASGNSRGHFGASASVGYQW

SEQ ID NO: 10 - protein, 594 aa, Neisseria meningitidis; identical to SEQ ID NO: 9

SEQ ID NO: 11 - protein, 598 aa, Neisseria meningitidis
MNKIYRIIWNSALNAWVVVSELTRNHTKRASATVATAVLATLLFATVQANATDDDDLYLEPVQRTAVVLSFRSDKEGTGEKEGTEDSNWAVYFDEKRVLKAGAITLKAGDNLKIKQNTNENTNENTNDSSFTYSLKKDLTDLTSVETEKLSFGANGNKVNITSDTKGLNFAKETAGTNGDPTVHLNGIGSTLTDTLLNTGATTNVTNDNVTDDEKKRAASVKDVLNAGWNIKGVKPGTTASDNVDFVRTYDTVEFLSADTKTTTVNVESKDNGKKTEVKIGAKTSVIKEKDGKLVTGKGKDENGSSTDEGEGLVTAKEVIDAVNKAGWRMKTTTANGQTGQADKFETVTSGTKVTFASGNGTTATVSKDDQGNITVKYDVNVGDALNVNQLQNSGWNLDSKAVAGSSGKVISGNVSPSKGKMDETVNINAGNNIEITRNGKNIDIATSMTPQFSSVSLGAGADAPTLSVDDEGALNVGSKDANKPVRITNVAPGVKEGDVTNVAQLKGVAQNLNNRIDNVDGNARAGIAQAIATAGLAQAYLPGKSMMAIGGGTYRGEAGYAIGYSSISDTGNWVIKGTASGNSRGHFGASASVGYQW

SEQ ID NO: 12 - protein, 599 aa, Neisseria meningitidis
MNKIYRIIWNSALNAWVAVSELTRNHTKRASATVKTAVLATLLFATVQANATDEDEEEELEPVVRSALVLQFMIDKEGNGENESTGNIGWSIYYDNHNTLHGATVTLKAGDNLKIKQNTNKNTNENTNDSSFTYSLKKDLTDLTSVETEKLSFGANGNKVNITSDTKGLNFAKETAGTNGDTTVHLNGIGSTLTDTLLNTGATTNVTNDNVTDDKKKRAASVKDVLNAGWNIKGVKPGTTASDNVDFVHTYDTVEFLSADTKTTTVNVESKDNGKRTEVKIGAKTSVIKEKDGKLVTGKGKGENGSSTDEGEGLVTAKEVIDAVNKAGWRMKTTTANGQTGQADKFETVTSGTNVTFASGKGTTATVSKDDQGNITVKYDVNVGDALNVNQLQNSGWNLDSKAVAGSSGKVISGNVSPSKGKMDETVNINAGNNIEITRNGKNIDIATSMTPQFSSVSLGAGADAPTLSVDDKGALNVGSKDANKPVRITNVAPGVKEGDVTNVAQLKGVAQNLNNRIDNVDGNARAGIAQAIATAGLVQAYLPGKSMMAIGGGTYRGEAGYAIGYSSISDGGNWIIKGTASGNSRGHFGASASVGYQW

SEQ ID NO: 13 - protein, 592 aa, Neisseria meningitidis
MNKIYRIIWNSALNAWVAVSELTRNHTKRASATVKTAVLATLLFATVQANATDEDEEEELESVQRSVVGSIQASMEGSGELETISLSMTNDSKEFVDPYIVVTLKAGDNLKIKQNTNENTNASSFTYSLKKDLTGLINVETEKLSFGANGKKVNIISDTKGLNFAKETAGTNGDTTVHLNGIGSTLTDTLAGSSASHVDAGNQSTHYTRAASIKDVLNAGWNIKGVKTGSTTGQSENVDFVRTYDTVEFLSADTKTTTVNVESKDNGKRTEVKIGAKTSVIKEKDGKLVTGKGKGENGSSTDEGEGLVTAKEVIDAVNKAGWRMKTTTANGQTGQADKFETVTSGTNVTFASGKGTTATVSKDDQGNITVMYDVNVGDALNVNQLQNSGWNLDSKAVAGSSGKVISGNVSPSKGKMDETVNINAGNNIEISRNGKNIDIATSMAPQFSSVSLGAGADAPTLSVDDEGALNVGSKDANKPVRITNVAPGVKEGDVTNVAQLKGVAQNLNNRIDNVDGNARAGIAQAIATAGLVQAYLPGKSMMAIGGGTYRGEAGYAIGYSSISDGGNWIIKGTASGNSRGHFGASASVGYQW

SEQ ID NO: 14 - protein, 592 aa, Neisseria meningitidis; identical to SEQ ID NO: 13

SEQ ID NO: 15 - protein, 592 aa, Neisseria meningitidis; identical to SEQ ID NO: 13

SEQ ID NO: 16 - protein, 592 aa, Neisseria meningitidis; identical to SEQ ID NO: 13

SEQ ID NO: 17 - protein, 592 aa, Neisseria meningitidis
MNKIYRIIWNSALNAWVAVSELTRNHTKRASATVKTAVLATLLFATVQANATDEDEEEELESVQRSVVGSIQASMEGSGELETISLSMTNDSKEFVDPYIVVTLKAGDNLKIKQNTNENTNASSFTYSLKKDLTGLINVETEKLSFGANGKKVNIISDTKGLNFAKETAGTNGDTTVHLNGIGSTLTDMLLNTGATTNVTNDNVTDDEKKRAASVKDVLNAGWNIKGVKPGTTASDNVDFVRTYDTVEFLSADTKTTTVNVESKDNGKKTEVKIGAKTSVIKEKDGKLVTGKGKGENGSSTDEGEGLVTAKEVIDAVNKAGWRMKTTTANGQTGQADKFETVTSGTNVTFASGKGTTATVSKDDQGNITVMYDVNVGDALNVNQLQNSGWNLDSKAVAGSSGKVISGNVSPSKGKMDETVNINAGNNIEITRNGKNIDIATSMTPQFSSVSLGAGADAPTLSVDDKGALNVGSKDANKPVRITNVAPGVKEGDVTNVAQLKGVAQNLNNRIDNVDGNARAGIAQAIATAGLVQAYLPGKSMMAIGGGTYRGEAGYAIGYSSISDGGNWIIKGTASGNSRGHFGASASVGYQW

SEQ ID NO: 18 - protein, 589 aa, Neisseria meningitidis
MNKIYRIIWNSALNAWVVVSELTRNHTKRASATVATAVLATLLSATVQANATDTDEDEELESVVRSALVLQFMIDKEGNGEIESTGDIGWSIYYDDHNTLHGATVTLKAGDNLKIKQSGKDFTYSLKKELKDLTSVETEKLSFGANGNKVNITSDTKGLNFAKETAGTNGDPTVHLNGIGSTLTDTLAGSSASHVDAGNQSTHYTRAASIKDVLNAGWNIKGVKTGSTTGQSENVDFVRTYDTVEFLSADTKTTTVNVESKDNGKRTEVKIGAKTSVIKEKDGKLVTGKGKGENGSSTDEGEGLVTAKEVIDAVNKAGWRMKTTTANGQTGQADKFETVTSGTKVTFASGNGTTATVSKDDQGNITVKYDVNVGDALNVNQLQNSGWNLDSKAVAGSSGKVISGNVSPSKGKMDETVNINAGNNIEITRNGKNIDIATSMTPQFSSVSLGAGADAPTLSVDDEGALNVGSKDANKPVRITNVAPGVKEGDVTNVAQLKGVAQNLNNRIDNVDGNARAGIAQAIATAGLAQAYLPGKSMMAIGGGTYRGEAGYAIGYSSISDTGNWVIKGTASGNSRGHFGTSASVGYQW

SEQ ID NO: 19 - protein, 589 aa, Neisseria meningitidis; identical to SEQ ID NO: 18

SEQ ID NO: 20 - protein, 595 aa, Neisseria meningitidis
MNKIYRIIWNSALNAWVVVSELTRNHTKRASATVETAVLATLLFATVQANATDTDEDDELEPVVRSALVLQFMIDKEGNGEIESTGDIGWSIYYDDHNTLHGATVTLKAGDNLKIKQNTDENTNASSFTYSLKKDLTDLTSVGTEELSFGANGNKVNITSDTKGLNFAKKTAGTNGDTTVHLNGIGSTLTDTLAGSSASHVDAGNQSTHYTRAASIKDVLNAGWNIKGVKTGSTTGQSENVDFVRTYDTVEFLSADTKTTTVNVESKDNGKRTEVKIGAKTSVIKEKDGKLVTGKGKGENGSSTDEGEGLVTAKEVIDAVNKAGWRMKTTTANGQTGQADKFETVTSGTNVTFASGKGTTATVSKDDQGNITVKYDVNVGDALNVNQLQNSGWNLDSKAVAGSSGKVISGNVSPSKGKMDETVNINAGNNIEITRNGKNIDIATSMTPQFSSVSLGAGADAPTLSVDDEGALNVGSKDANKPVRITNVAPGVKEGDVTNVAQLKGVAQNLNNHIDNVDGNARAGIAQAIATAGLVQAYLPGKSMMAIGGGTYRGEAGYAIGYSSISDGGNWIIKGTASGNSRGHFGASASVGYQW

SEQ ID NO: 21 - protein, 600 aa, Neisseria meningitidis
MNKIYRIIWNIALNAWVVVSELTRNHTKRASATVATAVLATLLSATVQANATDEEDNEDLEPVVRTAPVLSFHSDKEGTGEKEEVGASSNLTVYFDKNRVLKAGTITLKAGDNLKIKQNTNENTNENTNASSFTYSLKKDLTGLINVETEKLSFGANGKKVNIISDTKGLNFAKETAGTNGDPTVHLNGIGSTLTDTLAGSSASHVDAGNQSTHYTRAASIKDVLNAGWNIKGVKTGSTTGQSENVDFVRTYDTVEFLSADTKTTTVNVESKDNGKRTEVKIGAKTSVIKEKDGKLVTGKGKGENGSSTDEGEGLVTAKEVIDAVNKAGWRMKTTTANGQTGQADKFETVTSGTKVTFASGNGTTATVSKDDQGNITVKYDVNVGDALNVNQLQNSGWNLDSKAVAGSSGKVISGNVSPSKGKMDETVNINAGNNIEITRNGKNIDIATSMTPQFSSVSLGAGADAPTLSVDDEGALNVGSKDANKPVRITNVAPGVKEGDVTNVAQLKGVAQNLNNRIDNVDGNARAGIAQAIATAGLVQAYLPGKSMMAIGGGTYRGEAGYAIGYSSISDGGNWIIKGTASGNSRGHFGASASVGYQW

SEQ ID NO: 22 - protein, 288 aa, Neisseria gonorrhoeae
MKTFFKTLSAAALALILAACGGQKDSAPAASAAAPSADNGAAKKEIVFGTTVGDFGDMVKEQIQAELEKKGYTVKLVEFTDYVRPNLALAEGELDINVFQHKPYLDDFKKEHNLDITEAFQVPTAPLGLYPGKLKSLEEVKDGSTVSAPNDPSNFARALVMLNELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKYPAAWNEGAAK

SEQ ID NO: 23 - protein, 288 aa, Neisseria gonorrhoeae; identical to SEQ ID NO: 22

SEQ ID NO: 24 - protein, 288 aa, Neisseria gonorrhoeae; identical to SEQ ID NO: 22

SEQ ID NO: 25 - protein, 287 aa, Neisseria meningitidis
MKTFFKTLSAAALALILAACGGQKDSAPAASASAAADNGAEKKEIVFGTTVGDFGDMVKEHIQPELEKKGYTVKLVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 26 - protein, 287 aa, Neisseria meningitidis; identical to SEQ ID NO: 25

SEQ ID NO: 27 - protein, 287 aa, Neisseria meningitidis; identical to SEQ ID NO: 25

SEQ ID NO: 28 - protein, 287 aa, Neisseria meningitidis; identical to SEQ ID NO: 25

SEQ ID NO: 29 - protein, 287 aa, Neisseria meningitidis; identical to SEQ ID NO: 25

SEQ ID NO: 30 - protein, 287 aa, Neisseria meningitidis; identical to SEQ ID NO: 25

SEQ ID NO: 31 - protein, 287 aa, Neisseria meningitidis; identical to SEQ ID NO: 25

SEQ ID NO: 32 - protein, 287 aa, Neisseria meningitidis; identical to SEQ ID NO: 25

SEQ ID NO: 33 - protein, 287 aa, Neisseria meningitidis; identical to SEQ ID NO: 25

SEQ ID NO: 34 - protein, 287 aa, Neisseria meningitidis; identical to SEQ ID NO: 25

SEQ ID NO: 35 - protein, 287 aa, Neisseria meningitidis; identical to SEQ ID NO: 25

SEQ ID NO: 36 - protein, 287 aa, Neisseria meningitidis
MKTFFKTLSAAALALILAACGGQKDSAPAASASAAADNGAAKKEIVFGTTVGDFGDMVKEHIQPELEKKGYTVKLVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 37 - protein, 287 aa, Neisseria meningitidis
MKTFFKTLSAAALALILAACGGQKDSAPAASASAAADNGAEKKEIVFGTTVGDFGDMVKEQIQPELEKKGYTVKLVEFTDYVRPNLALAEGELDINVFQHKPYLDDFKKEHNLDITEVFQVPTAPLGLYPGKLKSLEEVKDGSTVSAPNDPSNFARALVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 38 - protein, 287 aa, Neisseria meningitidis
MKTFFKTLSAAALALILAACGGQKDSAPAASASAAADNGAEKKEIVFGTTVGDFGDMVKEQIQAELEKKGYTVKLVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 39 - protein, 287 aa, Neisseria meningitidis; identical to SEQ ID NO: 38

SEQ ID NO: 40 - protein, 287 aa, Neisseria meningitidis; identical to SEQ ID NO: 38

SEQ ID NO: 41 - protein, 287 aa, Neisseria meningitidis
MKTFFKTLSAAALALILAACGGQKDSAPAASASAAADNGAAKKEIVFGTTVGDFGDMVKEQIQAELEKKGYTVELVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 42 - protein, 287 aa, Neisseria meningitidis; identical to SEQ ID NO: 41

SEQ ID NO: 43 - protein, 287 aa, Neisseria meningitidis
MKTFFKTLSAAALALILAACGGQKDSAPAASASAAADNGAAKKEIVFGTTVGDFGDMVKEQIQPELEKKGYTVKLVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 44 - protein, 287 aa, Neisseria meningitidis; identical to SEQ ID NO: 43

SEQ ID NO: 45 - protein, 287 aa, Neisseria meningitidis; identical to SEQ ID NO: 43

SEQ ID NO: 46 - protein, 287 aa, Neisseria meningitidis
MKTFFKTLSAAALALILAACGGQKDSAPAASASAAADNGAAKKEIVFGTTVGDFGDMVKEQIQAELEKKGYTVKLVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 47 - protein, 287 aa, Neisseria meningitidis; identical to SEQ ID NO: 46

SEQ ID NO: 48 - protein, 287 aa, Neisseria meningitidis; identical to SEQ ID NO: 46

SEQ ID NO: 49 - protein, 287 aa, Neisseria meningitidis
MKTFFKTLSAAALALILAACGGQKDSAPAASASAAADNGAAKKEIVFGTTVGDFGDMVKEQIQVELEKKGYTVKLVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 50 - protein, 287 aa, Neisseria meningitidis; identical to SEQ ID NO: 49

SEQ ID NO: 51 - protein, 287 aa, Neisseria meningitidis
MKTFFKTLSAAALALILAACGGQKDSAPAASASAAADNGAAKKEIVFGTTVGDFGDMVKEQIQPELEKKGYTVELVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 52 - protein, 287 aa, Neisseria meningitidis; identical to SEQ ID NO: 46

SEQ ID NO: 53 - protein, 287 aa, Neisseria meningitidis; identical to SEQ ID NO: 25

SEQ ID NO: 54 - protein, 251 aa, Neisseria meningitidis
MDSFFKPAVWAVLWLMFAVRPALADELTNLLSSREQILRQFAEDEQPVLPINRAPARRAGNADELIGSAMGLNEQPVLPVNRVPARRAGNADELIGSAMGLNEQPVLPVNRAPARRAGNADELIGNAMGLLGIAYRYGGTSISTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 55 - protein, 251 aa, Neisseria meningitidis; identical to SEQ ID NO: 54

SEQ ID NO: 56 - protein, 280 aa, Neisseria meningitidis
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLNEQPVLPVNRVPARRAGNADELIGNAMGLNEQPVLPVNRAPARRAGNADELIGNAMGLLGIAYRYGGTSISTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 57 - protein, 280 aa, Neisseria meningitidis
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLNEQPVLPVNRAPARRAGNADELIGNAMGLNEQPVLPVNRAPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 58 - protein, 280 aa, Neisseria meningitidis
MDSFFKPAVWAVLWLMFAVRPALADELTNLLSSREQILRQFAEDEQPVLPINRAPARRAGNADELIGSAMGLNEQPVLPINRAPARRAGNADELIGSAMGLNEQPVLPVNRVPARRAGNADELIGNAMGLNEQPVLPVNRAPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 59 - protein, 251 aa, Neisseria meningitidis
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLNEQPVLPVNRAPARRAGNADELIGNAMGLLGIAYRYGGTSISTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 60 - protein, 251 aa, Neisseria meningitidis; identical to SEQ ID NO: 59

SEQ ID NO: 61 - protein, 251 aa, Neisseria meningitidis; identical to SEQ ID NO: 59

SEQ ID NO: 62 - protein, 251 aa, Neisseria meningitidis; identical to SEQ ID NO: 59

SEQ ID NO: 63 - protein, 251 aa, Neisseria meningitidis; identical to SEQ ID NO: 59

SEQ ID NO: 64 - protein, 251 aa, Neisseria meningitidis; identical to SEQ ID NO: 59

SEQ ID NO: 65 - protein, 251 aa, Neisseria meningitidis; identical to SEQ ID NO: 59

SEQ ID NO: 66 - protein, 251 aa, Neisseria meningitidis; identical to SEQ ID NO: 59

SEQ ID NO: 67 - protein, 251 aa, Neisseria meningitidis; identical to SEQ ID NO: 59

SEQ ID NO: 68 - protein, 251 aa, Neisseria meningitidis
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLNEQPVLPVNRAPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 69 - protein, 251 aa, Neisseria meningitidis; identical to SEQ ID NO: 68

SEQ ID NO: 70 - protein, 251 aa, Neisseria meningitidis; identical to SEQ ID NO: 68

SEQ ID NO: 71 - protein, 251 aa, Neisseria meningitidis; identical to SEQ ID NO: 68

SEQ ID NO: 72 - protein, 251 aa, Neisseria meningitidis; identical to SEQ ID NO: 68

SEQ ID NO: 73 - protein, 251 aa, Neisseria meningitidis; identical to SEQ ID NO: 68

SEQ ID NO: 74 - protein, 251 aa, Neisseria meningitidis; identical to SEQ ID NO: 68

SEQ ID NO: 75 - protein, 251 aa, Neisseria meningitidis; identical to SEQ ID NO: 68

SEQ ID NO: 76 - protein, 251 aa, Neisseria meningitidis; identical to SEQ ID NO: 68

SEQ ID NO: 77 - protein, 251 aa, Neisseria meningitidis; identical to SEQ ID NO: 68

SEQ ID NO: 78 - protein, 251 aa, Neisseria meningitidis; identical to SEQ ID NO: 68

SEQ ID NO: 79 - protein, 251 aa, Neisseria meningitidis; identical to SEQ ID NO: 68

SEQ ID NO: 80 - protein, 251 aa, Neisseria meningitidis; identical to SEQ ID NO: 68

SEQ ID NO: 81 - protein, 251 aa, Neisseria meningitidis; identical to SEQ ID NO: 68

SEQ ID NO: 82 - protein, 251 aa, Neisseria meningitidis
MDSFFKPAVWAVLWLMFAVRPALADELTNLLSSREQILRQFAEDEQPVLPVNRAPARRAGNADELIGSAMGLNEQPVLPVNRVPARRAGNADELIGNAMGLNEQPVLPVNRAPARRAGNADELIGNAMGLLGIAYRYGGTSVSTGFDCSGFIQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 83 - protein, 251 aa, Neisseria meningitidis
MDSFFKPAVWAVLWLMFAVRLALADELTNLLSSREQILRQFAEDEQPVLPINRAPARRAGNADELIGSAMGLNEQPVLPVNRVPARRAGNADELIGNAMGLNEQPVLPVNRAPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 84 - protein, 222 aa, Neisseria meningitidis
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 85 - protein, 222 aa, Neisseria gonorrhoeae
MDSFFKPAVWAVLWLMFAVRPALADELTNLLSSREQILRQFAEDEQPVLPVNRAPARRAGNADELIGSAMGLNEQPVLPVNRAPARRAGNADELIGSAMGLLGIAYRYGGTSVSTGFDCSGFMQHIFKRAMGINLPRTSAEQARMGAPVARSELQPGDMVFFRTLGGSRISHVGLYIGNNRFIHAPRTGKNIEITSLSHKYWSGKYAFARRVKKNDPSRFLN

SEQ ID NO: 86 - protein, 222 aa, Neisseria gonorrhoeae; identical to SEQ ID NO: 85

SEQ ID NO: 87 - protein, 222 aa, Neisseria gonorrhoeae
MDSFFKPAVWAVLWLMFAVRSALADELTNLLSSREQILRQFAEDEQPVLPVNRAPARRAGNADELIGSAMGLNEQPVLPVNRAPARRAGNADELIGSAMGLLGIAYRYGGTSVSTGFDCSGFMQHIFKRAMGINLPRTSAEQARMGAPVARSELQPGDMVFFRTLGGSRISHVGLYIGNNRFIHAPRTGKNIEITSLSHKYWSGKYAFARRIKKNDPSRFLN

SEQ ID NO: 88 - protein, 215 aa, Neisseria meningitidis
MKPLILGLAAALVLSACQVQKAPDFDYTSFKESKPASILVVPPLNESPDVNGTWGMLASTAEPLSEAGYYVFPAAVVEETFKQNGLTNAADIHAVQPEKLHQIFGNDAVLYITITEYGTSYQILDSVTTVSARARLVDSRNGKVLWSGSASIREGSNNSNSGLLGALVSAVVNQIANSLTDRGYQVSKTAAYNLLSPYSHNGILKGPRFVEEQPK

SEQ ID NO: 89 - protein, 215 aa, Neisseria meningitidis
MKPLILGLAAVLALSACQVQKAPDFDYTAFKESKPASILVVPPLNESPDVNGTWGMLASTAEPLSEAGYYVFPAAVVEETFKQNGLTNAADIHAVRPEKLHQIFGNDAVLYITITEYGTSYQILDSVTTVSARARLVDSRNGKVLWSGSASIREGSNNSNSGLLGALVGAVVNQIANSLTDRGYQVSKAAAYDLLSPYSHNGILKGPRFVEEQPK

SEQ ID NO: 90 - protein, 215 aa, Neisseria gonorrhoeae
MKPLILGLAAVLALSACQVRKAPDLDYTSFKESKPASILVVPPLNESPDVNGTWGMLASTAAPISEAGYYVFPAAVVEETFKENGLTNAADIHAVRPEKLHQIFGNDAVLYITVTEYGTSYQILDSVTTVSAKARLVDSRNGKELWSGSASIREGSNNSNSGLLGALVGAVVNQIANSLTDRGYQVSKTAAYNLLSPYSRNGILKGPRFVEEQPK

SEQ ID NO: 91 - protein, 215 aa, Neisseria gonorrhoeae; identical to SEQ ID NO: 90

SEQ ID NO: 92 - protein, 215 aa, Neisseria gonorrhoeae; identical to SEQ ID NO: 90

SEQ ID NO: 93 - protein, 215 aa, Neisseria meningitidis
MKPLILGLAAVLALSACQVQKAPDFDYTSFKESKPASILVVPPLNESPDVNGTWGVLASTAAPLSEAGYYVFPAAVVEETFKENGLTNAADIHAVRPEKLHQIFGNDAVLYITVTEYGTSYQILDSVTTVSAKARLVDSRNGKELWSGSASIREGSNNSNSGLLGALVSAVVNQIANNLTDRGYQVSKTAAYNLLSPYSHNGILKGPRFVEEQPK

SEQ ID NO: 94 - protein, 215 aa, Neisseria meningitidis; identical to SEQ ID NO: 93

SEQ ID NO: 95 - protein, 215 aa, Neisseria meningitidis; identical to SEQ ID NO: 93

SEQ ID NO: 96 - protein, 215 aa, Neisseria meningitidis
MKPLILGLAAVLALSACQVQKAPDFDYTSFKESKPASILVVPPLNESPDVNGTWGVLASTAAPLSEAGYYVFPAAVVEETFKQNGLTNAADIHAVRPEKLHQIFGNDAVLYITVTEYGTSYQILDSVTTVSAKARLVDSRNGKELWSGSASIREGSNNSNSGLLGALVSAVVNQIANSLTDRGYQVSKTAAYNLLSPYSHNGILKGPRFVEEQPK

SEQ ID NO: 97 - protein, 215 aa, Neisseria meningitidis; identical to SEQ ID NO: 96

SEQ ID NO: 98 - protein, 215 aa, Neisseria meningitidis; identical to SEQ ID NO: 96

SEQ ID NO: 99 - protein, 215 aa, Neisseria meningitidis; identical to SEQ ID NO: 96

SEQ ID NO: 100 - protein, 215 aa, Neisseria meningitidis; identical to SEQ ID NO: 96

SEQ ID NO: 101 - protein, 215 aa, Neisseria meningitidis; identical to SEQ ID NO: 96

SEQ ID NO: 102 - protein, 215 aa, Neisseria meningitidis; identical to SEQ ID NO: 96

SEQ ID NO: 103 - protein, 215 aa, Neisseria meningitidis; identical to SEQ ID NO: 96

SEQ ID NO: 104 - protein, 215 aa, Neisseria meningitidis; identical to SEQ ID NO: 96

SEQ ID NO: 105 - protein, 215 aa, Neisseria meningitidis; identical to SEQ ID NO: 96

SEQ ID NO: 106 - protein, 215 aa, Neisseria meningitidis; identical to SEQ ID NO: 96

SEQ ID NO: 107 - protein, 215 aa, Neisseria meningitidis; identical to SEQ ID NO: 96

SEQ ID NO: 108 - protein, 215 aa, Neisseria meningitidis; identical to SEQ ID NO: 96

SEQ ID NO: 109 - protein, 215 aa, Neisseria meningitidis; identical to SEQ ID NO: 96

SEQ ID NO: 110 - protein, 215 aa, Neisseria meningitidis; identical to SEQ ID NO: 96

SEQ ID NO: 111 - protein, 215 aa, Neisseria meningitidis; identical to SEQ ID NO: 96

SEQ ID NO: 112 - protein, 215 aa, Neisseria meningitidis; identical to SEQ ID NO: 96

SEQ ID NO: 113 - protein, 215 aa, Neisseria meningitidis; identical to SEQ ID NO: 96

SEQ ID NO: 114 - protein, 215 aa, Neisseria meningitidis; identical to SEQ ID NO: 96

SEQ ID NO: 115 - protein, 215 aa, Neisseria meningitidis; identical to SEQ ID NO: 96

SEQ ID NO: 116 - protein, 215 aa, Neisseria meningitidis
MKPLILGLAAVLALSACQVQKAPDFDYTSFKESKPASILVVPPLNESPDVNGTWGVLASTAAPLSEAGYYVFPAAVVEETFKQNGLTNAADIHAVRPEKLHQIFGNDAVLYITVTEYGTSYQILDSVTTVSAKARLVDSRNGKELWSGSASIREGSNNSNSGLLGALVGAVVNQIANSLTDRGYQVSKTAAYNLLSPYSHNGILKGPRFVEEQPK

SEQ ID NO: 117 - protein, 215 aa, Neisseria meningitidis; identical to SEQ ID NO: 116

SEQ ID NO: 118 - protein, 215 aa, Neisseria meningitidis
MKPLILGLAAVLALSACQVQKAPDFDYTSFKESKPASILVVPPLNESPDVNGTWGMLASTAAPLSEAGYYVFPAAVVEETFKQNGLTNAADIHAVRPEKLHQIFGNDAVLYITVTEYGTSYQILDSVTTVSAKARLVDSRNGKELWSGSASIREGSNNSNSGLLGALVGAVVNQIANSLTDRGYQVSKTAAYNLLSPYSHNGILKGPRFVEEQPK

SEQ ID NO: 119 - protein, 492 aa, Neisseria meningitidis
MFKRSVIAMACIFALSACGGGGGGSPDVKSADTLSKPAAPVVSEKETEAKEDAPQAGSQGQGAPSAQGGQDMAAVSEENTGNGGAAATDKPKNEDEGAQNDMPQNAADTDSLTPNHTPASNMPAGNMENQAPDAGESEQPANQPDMANTADGMQGDDPSAGGENAGNTAAQGTNQAENNQTAGSQNPASSTNPSATNSGGDFGRTNVGNSVVIDGPSQNITLTHCKGDSCSGNNFLDEEVQLKSEFEKLSDADKISNYKKDGKNDGKNDKFVGLVADSVQMKGINQYIIFYKPKPTSFARFRRSARSRRSLPAEMPLIPVNQADTLIVDGEAVSLTGHSGNIFAPEGNYRYLTYGAEKLPGGSYALRVQGEPSKGEMLAGTAVYNGEVLHFHTENGRPSPSRGRFAAKVDFGSKSVDGIIDSGDGLHMGTQKFKAAIDGNGFKGTWTENGGGDVSGKFYGPAGEEVAGKYSYRPTDAEKGGFGVFAGKKEQD

SEQ ID NO: 120 - protein, 492 aa, Neisseria meningitidis; identical to SEQ ID NO: 119

SEQ ID NO: 121 - protein, 488 aa, Neisseria meningitidis
MFKRSVIAMACIFALSACGGGGGGSPDVKSADTLSKPAAPVVSEKETEAKEDAPQAGSQGQGAPSAQGSQDMAAVSEENTGNGGAVTADNPKNEDEVAQNDMPQNAAGTDSSTPNHTPDPNMLAGNMENQATDAGESSQPANQPDMANAADGMQGDDPSAGGQNAGNTAAQGANQAGNNQAAGSSDPIPASNPAPANGGSNFGRVDLANGVLIDGPSQNITLTHCKGDSCSGNNFLDEEVQLKSEFEKLSDADKISNYKKDGKNDKFVGLVADSVQMKGINQYIIFYKPKPTSFARFRRSARSRRSLPAEMPLIPVNQADTLIVDGEAVSLTGHSGNIFAPEGNYRYLTYGAEKLPGGSYALRVQGEPAKGEMLAGAAVYNGEVLHFHTENGRPYPTRGRFAAKVDFGSKSVDGIIDSGDDLHMGTQKFKAAIDGNGFKGTWTENGSGDVSGKFYGPAGEEVAGKYSYRPTDAEKGGFGVFAGKKEQD

SEQ ID NO: 122 - protein, 488 aa, Neisseria meningitidis; identical to SEQ ID NO: 121

SEQ ID NO: 123 - protein, 497 aa, Neisseria meningitidis
MFKRSVIAMACIVALSACGGGGGGSPDVKSADTLSKPAAPVVTEDVGEEVLPKEKKDEEAVSGAPQADTQDATAGKGGQDMAAVSAENTGNGGAATTDNPENKDEGPQNDMPQNAADTDSSTPNHTPAPNMPTRDMGNQAPDAGESAQPANQPDMANAADGMQGDDPSAGENAGNTADQAANQAENNQVGGSQNPASSTNPNATNGGSDFGRINVANGIKLDSGSENVTLTHCKDKVCDRDFLDEEAPPKSEFEKLSDEEKINKYKKDEQRENFVGLVADRVEKNGTNKYVIIYKDKSASSSSARFRRSARSRRSLPAEMPLIPVNQADTLIVDGEAVSLTGHSGNIFAPEGNYRYLTYGAEKLSGGSYALSVQGEPAKGEMLAGTAVYNGEVLHFHMENGRPSPSGGRFAAKVDFGSKSVDGIIDSGDDLHMGTQKFKAVIDGNGFKGTWTENGGGDVSGRFYGPAGEEVAGKYSYRPTDAEKGGFGVFAGKKEQD

SEQ ID NO: 124 - protein, 429 aa, Neisseria gonorrhoeae
MFKRSVIAMACIFPLSACGGGGGGSPDVKSADTPSKPAAPVVAENAGEGVLPKEKKDEEAAGGAPQADTQDATAGEGSQDMAAVSAENTGNGGAATTDNPKNEDAGAQNDMPQNAAESANQTGNNQPAGSSDSAPASNPAPANGGSDFGRTNVGNSVVIDGPSQNITLTHCKGDSCNGDNLLDEEAPSKSEFEKLSDEEKIKRYKKDEQRENFVGLVADRVKKDGTNKYIIFYTDKPPTRSARSRRSLPAEIPLIPVNQADTLIVDGEAVSLTGHSGNIFAPEGNYRYLTYGAEKLPGGSYALRVQGEPAKGEMLVGTAVYNGEVLHFHMENGRPYPSGGRFAAKVDFGSKSVDGIIDSGDDLHMGTQKFKAAIDGNGFKGTWTENGGGDVSGRFYGPAGEEVAGKYSYRPTDAEKGGFGVFAGKKDRD

SEQ ID NO: 125 - protein, 315 aa, Neisseria meningitidis
MEFFIILLAAVVVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 126 - protein, 315 aa, Neisseria meningitidis
MEFFIILLAAVVVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 127 - protein, 315 aa, Neisseria meningitidis; identical to SEQ ID NO: 125

SEQ ID NO: 128 - protein, 315 aa, Neisseria gonorrhoeae
MEFFIILLAAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRAMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 129 - protein, 315 aa, Neisseria gonorrhoeae; identical to SEQ ID NO: 128

SEQ ID NO: 130 - protein, 315 aa, Neisseria meningitidis
MEFFIILLAAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 131 - protein, 315 aa, Neisseria meningitidis; identical to SEQ ID NO: 130

SEQ ID NO: 132 - protein, 315 aa, Neisseria meningitidis; identical to SEQ ID NO: 130

SEQ ID NO: 133 - protein, 315 aa, Neisseria meningitidis
MEFFIILLVAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 134 - protein, 315 aa, Neisseria meningitidis; identical to SEQ ID NO: 133

SEQ ID NO: 135 - protein, 315 aa, Neisseria meningitidis; identical to SEQ ID NO: 133

SEQ ID NO: 136 - protein, 315 aa, Neisseria meningitidis; identical to SEQ ID NO: 133

SEQ ID NO: 137 - protein, 315 aa, Neisseria meningitidis
MEFFIILLVAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 138 - protein, 315 aa, Neisseria meningitidis; identical to SEQ ID NO: 137

SEQ ID NO: 139 - protein, 315 aa, Neisseria meningitidis; identical to SEQ ID NO: 137

SEQ ID NO: 140 - protein, 315 aa, Neisseria meningitidis; identical to SEQ ID NO: 137

SEQ ID NO: 141 - protein, 315 aa, Neisseria meningitidis; identical to SEQ ID NO: 137

SEQ ID NO: 142 - protein, 315 aa, Neisseria meningitidis; identical to SEQ ID NO: 137

SEQ ID NO: 143 - protein, 315 aa, Neisseria meningitidis; identical to SEQ ID NO: 137

SEQ ID NO: 144 - protein, 315 aa, Neisseria meningitidis; identical to SEQ ID NO: 137

SEQ ID NO: 145 - protein, 315 aa, Neisseria meningitidis; identical to SEQ ID NO: 133

SEQ ID NO: 146 - protein, 315 aa, Neisseria meningitidis
MEFFIILLAAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSIVVSALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 147 - protein, 441 aa, Neisseria gonorrhoeae
MKKHLLRSALYGIAAAILAACQSRSIQTFPQPDTSVINGPDRPAGIPDPAGTTVAGGGAVYTVVPHLSMPHWAAQDFAKSLQSFRLGCANLKNRQGWQDVCAQAFQTPVHSFQAKRFFERYFTPWQVAGNGSLAGTVTGYYEPVLKGDGRRTERARFPIYGIPDDFISVPLPAGLRGGKNLVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSGNEGPVGALGTPLMGEYAGAIDRHYITLGAPLFVATAHPVTRKALNRLIMAQDTGSAIKGAVRVDYFWGYGDEAGELAGKQKTTGYVWQLLPNGMKPEYRP

SEQ ID NO: 148 - protein, 441 aa, Neisseria gonorrhoeae
MKKHLLRSALYGIAAAILAACQSRSIQTFPQPDTSVINGPDRPAGIPDPAGTTVAGGGAVYTVVPHLSMPHWAAQDFAKSLQSFRLGCANLKNRQGWQDVCAQAFQTPIHSFQAKRFFERYFTPWQVAGNGSLAGTVTGYYEPVLKGDGRRTERARFPIYGIPDDFISVPLPAGLRGGKNLVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKSYMRQNPHKLAEVLGQNPSYIFFRELAGSGNEGPVGALGTPLMGEYAGAIDRHYITLGAPLFVATAHPVTRKALNRLIMAQDTGSAIKGAVRVDYFWGYGDEAGELAGKQKTTGYVWQLLPNGMKPEYRP

SEQ ID NO: 149 - protein, 441 aa, Neisseria gonorrhoeae
MKKHLLRSALYGIAAAILAACQSRSIQTFPQPDTSVINGPDRPAGIPDPAGTTVAGGGAVYTVVPHLSMPHWAAQDFAKSLQSFRLGCANLKNRQGWQDVCAQAFQTPVHSFQAKRFFERYFTPWQVAGNGSLAGTVTGYYEPVLKGDGRRTERARFPIYGIPDDFISVPLPAGLRGGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSGGDGPVGALGTPLMGGYAGAIDRHYITLGAPLFVATAHPVTRKALNRLIMAQDTGSAIKGAVRVDYFWGYGDEAGELAGKQKTTGYVWQLLPNGMKPEYRP

SEQ ID NO: 150 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELAGSSNDGPVGALGTPLMGEYAGAVDRHYITLGAPLFVATAHPVTSKALNRLIMAQDTGSAIKGAVRVDYFWGYGDEAGETAGKMKEPGYVWQLLPNGMKPEYRP

SEQ ID NO: 151 - protein, 441 aa, Neisseria meningitidis
MKKYLFRAALYGISAAILAACQSKSIQTFPQPDTSVINGPDRPAGIPDPAGTTVAGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKSYMRQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGETAGKMKEPGYVWQLLPNGMKPEYRP

SEQ ID NO: 152 - protein, 441 aa, Neisseria meningitidis
MKKYLFRAALCGIAAAILAACQSKSIQTFPQPDTSVINGPDRPVGIPAPAGTTVAGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSGNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 153 - protein, 441 aa, Neisseria meningitidis; identical to SEQ ID NO: 152

SEQ ID NO: 154 - protein, 441 aa, Neisseria meningitidis; identical to SEQ ID NO: 152

SEQ ID NO: 155 - protein, 441 aa, Neisseria meningitidis; identical to SEQ ID NO: 152

SEQ ID NO: 156 - protein, 441 aa, Neisseria meningitidis
MKKYLFRAALCGIAAAILAACQSKSIQTFPQPDTSVINGPDRPVGIPAPAGTTVAGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSRNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 157 - protein, 441 aa, Neisseria meningitidis
MKKYLFRAALCGIAAAILAACQSKSIQTFPQPDTSVINGPDRPVGIPAPAGTTVAGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMQQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 158 - protein, 441 aa, Neisseria meningitidis
MKKYLFRAALCGIAAAILAACQSKSIQTFPQPDTSVINGPDRPVGIPAPAGTTVGGGGAVYTVVPHLSLPHWAAQDFAKSLQSFRLGCANLKNRQGWQDVCAQAFQTPVHSVQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 159 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 160 - protein, 441 aa, Neisseria meningitidis; identical to SEQ ID NO: 159

SEQ ID NO: 161 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKSYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 162 - protein, 441 aa, Neisseria meningitidis; identical to SEQ ID NO: 161

SEQ ID NO: 163 - protein, 441 aa, Neisseria meningitidis; identical to SEQ ID NO: 161

SEQ ID NO: 164 - protein, 441 aa, Neisseria meningitidis; identical to SEQ ID NO: 161

SEQ ID NO: 165 - protein, 441 aa, Neisseria meningitidis; identical to SEQ ID NO: 161

SEQ ID NO: 166 - protein, 441 aa, Neisseria meningitidis; identical to SEQ ID NO: 161

SEQ ID NO: 167 - protein, 441 aa, Neisseria meningitidis; identical to SEQ ID NO: 161

SEQ ID NO: 168 - protein, 441 aa, Neisseria meningitidis; identical to SEQ ID NO: 161

SEQ ID NO: 169 - protein, 441 aa, Neisseria meningitidis; identical to SEQ ID NO: 161

SEQ ID NO: 170 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 171 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 172 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAEQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 173 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLSCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 174 - protein, 441 aa, Neisseria meningitidis
MKKYLFRAALCGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSVQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMQQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 175 - protein, 441 aa, Neisseria meningitidis; identical to SEQ ID NO: 174

SEQ ID NO: 176 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSVQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMQQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 177 - protein, 441 aa, Neisseria meningitidis
MKKYLFRAALCGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 178 - protein, 441 aa, Neisseria meningitidis
MKKYLFRAALCGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKSYMRQNPQRLAEVLGQNPSYIFFRELTGSGNDGPVGALGTPLMGEYAGAVDRHYITLGAPLFVATTHPITRKALNRLIMAQDTGSAIKGAVRVDYFWGYGDEAGELAGKQKTTGYVWQLLPNGMKPEYRP

SEQ ID NO: 179 - protein, 441 aa, Neisseria meningitidis
MKKYLFRAALCGIAAAILAACQSKSIQTFPQPDTSVINGPGRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 180 - protein, 441 aa, Neisseria meningitidis
MKKYLFRAALYGIAAAILAACQSKSIQTFPQPDTSVINGPDRPVGIPDLAGTTVGGGGAVYTVVPHLSLPHWAAQDFAKSLQSFRLGCANLKNHQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSGNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 181 - protein, 441 aa, Neisseria meningitidis
MKKHLFRAALYGIAAAILAACQSKSIQTFPQPDTSIIKGPDRPAGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYVFFRELAGSGNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 182 - protein, 608 aa, Neisseria meningitidis
LGISRKISLILSILAVCLPMHAHASDLANDSFIRQVLDRQHFEPDGKYHLFGSRGELAERSGHIGLGNIQSHQLGNLMIQQAAIKGNIGYIVRFSDHGHEVHSPFDNHASHSDSDEAGSPVDGFSLYRIHWDGYEHHPADGYDGPQGGGYPVPKGARDIYSYDIKGVAQNIRLNLTDNRSTGQRLADRFHNAGAMLTQGVGDGFKRATRYSPELDRSGNAAEAFNGTADIVKNIIGAAGEIVGAGDAVQGISEGSNIAVMHGLGLLSTENKMARINDLADMAQLKDYAAAAIRDWAVQNPNAAQGIEAVSNIFTAVIPIKGIGAVRGKYGLGGITAHPVKRSQMGAIALPKGKSAVSNNFADAAYAKYPSPYHSRNIRSNLEQRYGKENITSSTVPPSNGKNVKLADQRHPKTGVPFDGKGFPNFEKHVKYDTKLDIQELSGGGIPKAKPVFDAKPRWEVDRKLNKLTTREQVEKNVQEIRNGNKNSNFSQHAQLEREINKLKSADEINFADGMGKFTDSMNDKAFSRLVKSVKENGFTNPVVEYVEINGKAYIVRGNNRVFAAEYLGRIHELKFKKVDFPVPNTSWKNPTDVLNESGNVKRPRYRSK

SEQ ID NO: 183 - protein, 427 aa, Neisseria meningitidis
RKISLILSILAVCLPMHAHASDLANDSFIRQVLDRQHFEPDGKYHLFGSRGELAERSGHIGLGKIQSHQLGNLFIQQAAIKGNIGYIVRFSDHGHEVHSPFDNHASHSDSDEAGSPVDGFSLYRIHWDGYEHHPADGYDGPQGGGYPAPKGARDIYSYDIKGVAQNIRLNLTDNRSTGQRLADRFHNAGAMLTQGVGDGFKRATRYSPELDRSGNAAEAFNGTADIVKNIIGAAGEIVGAGDAVQGISEGSNIAVMHGLGLLSTENKMARINDLADMAQLKDYAAAAIRDWAVQNPNAAQGIEAVSNIFTAVIPVKGIGAVRGKYGLGGITAHPVKRSQMGAIALPKGKSAVSNNFADAAYAKYPSPYHSRNIRSNLEQRYGKENITSSTVPPSNGKNVKLADQRHPKTGVPFDGKGFPNFEKHVKY

SEQ ID NO: 184 - protein, 423 aa, Neisseria meningitidis
KISLILSILAVCLPMHAHASDLANDSFIRQVLDRQHFEPDGKYHLFGSRGELAERSGHIGLGNIQSHQLGNLMIQQAAIKGNIGYIVRFSDHGHEVHSPFDNHASHSDSDEAGSPVDGFSLYRIHWDGYEHHPADGYDGPQGGGYPAPKGARDIYSYDIKGVAQNIRLNLTDNRSTGQRLADRFHNAGAMLTQGVGDGFKRATRYSPELDRSGNAAEAFNGTADIVKNIIGAAGEIVGAGDAVQGISEGSNIAVMHGLGLLSTENKMARINDLADMAQLKDYAAAAIRDWAVQNPNAAQGIEAVSNIFMAAIPIKGIGAVRGKYGLGGITAHPIKRSQMGAIALPKGKSAVSDNFADAAYAKYPSPYHSRNIRSNLEQRYGKENITSSTVPPSNGKNVKLADQRHPKTGVPFDGKGFPNFEKH

SEQ ID NO: 185 - protein, 608 aa, Neisseria meningitidis
LGISRKISLILSILAVCLPMHAHASDLANDSFIRQVLDRQHFEPDGKYHLFGSRGELAERSGHIGLGNIQSHQLGNLMIQQAAIKGNIGYIVRFSDHGHEVHSPFDNHASHSDSDEAGSPVDGFSLYRIHWDGYEHHPADGYDGPQGGGYPAPKGARDIYSYDIKGVAQNIRLNLTDNRSTGQRLADRFHNAGAMLTQGVGDGFKRATRYSPELDRSGNAAEAFNGTADIVKNIIGAAGEIVGAGDAVQGISEGSNIAVMHGLGLLSTENKMARINDLADMAQLKDYAAAAIRDWAVQNPNAAQGIEAVSNIFMAAIPIKGIGAVRGKYGLGGITAHPIKRSQMGAIALPKGKSAVSDNFADAAYAKYPSPYHSRNIRSNLEQRYGKENITSSTVPPSNGKNVKLADQRHPKTGVPFDGKGFPNFEKHVKYDTKLDIQELSGGGIPKAKPVSDAKPRWEVDRKLNKLTTREQVEKNVQEIRNGNKNSNFNQHAQLEREINKLKSADEINFADGMGKFTDSMDDKAFSRLVKSVKENGFTNPVVEYVEINGKAYIVRGNNRVFAAEYLGRIHELKFKKVDFPVPNTSWKNPTDVLNESGNVKRPRYRSK

SEQ ID NO: 186 - protein, 608 aa, Neisseria meningitidis
LGISRKISLILSILAVCLPMHAHASDLANDSFIRQVLDRQHFEPDGKYHLFGSRGELAERSGHIGLGKIQSHQLGNLMIQQAAIKGNIGYIVRFSDHGHEVHSPFDNHASHSDSDEAGSPVDGFSLYRIHWDGYEHHPADGYDGPQGGGYPAPKGARDIYSYDIKGVAQNIRLNLTDNRSTGQRLADRFHNAGSMLTQGVGDGFKRATRYSPELDRSGNAAEAFNGTADIVKNIIGAAGEIVGAGDAVQGISEGSNIAVMHGLGLLSTENKMARINDLADMAQLKDYAAAAIRDWAVQNPNAAQGIEAVSNIFMAAIPIKGIGAVRGKYGLGGITAHPIKRSQMGAIALPKGKSAVSDNFADAAYAKYPSPYHSRNIRSNLEQRYGKENITSSTVPPSNGKNVKLADQRHPKTGVPFDGKGFPNFEKHVKYDTKLDIQELSGGGIPKAKPVSDAKPRWEVDRKLNKLTTREQVEKNVQEIRNGNKNSNFSQHAQLEREINKLKSADEINFADGMGKFTDSMNDKAFSRLVKSVKENGFTNPVVEYVEINGKAYIVRGNNRVFAAEYLGRIHELKFKKVDFPVPNTSWKNPTDVLNESGNVKRPRYRSK

SEQ ID NO: 187 - protein, 608 aa, Neisseria meningitidis
LGISRKISLILSILAVCLPMHAHASDLANDSFIRQVLDRQHFEPDGKYHLFGSRGELAERSGHIGLGKIQSHQLGNLMIQQAAIKGNIGYIVRFSDHGHEVHSPFDNHASHSDSDEAGSPVDGFSLYRIHWDGYEHHPADGYDGPQGGGYPAPKGARDIYSYDIKGVAQNIRLNLTDNRSTGQRLADRFHNAGSMLTQGVGDGFKRATRYSPELDRSGNAAEAFNGTADIVKNIIGAAGEIVGAGDAVQGISEGSNIAVMHGLGLLSTENKMARINDLADMAQLKDYAAAAIRDWAVQNPNAAQGIEAVSNIFMAAIPIKGIGAVRGKYGLGGITAHPIKRSQMGAIALPKGKSAVSDNFADAAYAKYPSPYHSRNIRSNLEQRYGKENITSSTVPPSNGKNVKLADQRHPKTGVPFDGKGFPNFEKHVKYDTKLDIQELSGGGIPKAKPVFDAKPRWEVDRKLNKLTTREQVEKNVQEIRNGNINSNFSQHAQLEREINKLKSADEINFADGMGKFTDSMNDKAFSRLVKSVKENGFTNPVVEYVEINGKAYIVRGNNRVFAAEYLGRIHELKFKKVDFPVPNTSWKNPTDVLNESGNVKRPRYRSK

SEQ ID NO: 188 - protein, 201 aa, Neisseria meningitidis
MTIYFKNGFYDDTLGGIPEGAVAVRAEEYAALLAGQAQGGQIAADSDGRPVLTPPRPSEYHEWDGKKWEIGEAAAAARFAEQKTATAFRLAAKADELKNSLLAGYPQVEIDSFYRQEKEALARQADNNAPTPMLAQIAATRGVELDVLIEKVIEKSARLAVAAGAIIGKRQQLEDKLNTIETAPGLDALEKEIEEWTLNIG

SEQ ID NO: 189 - protein, 201 aa, Neisseria meningitidis; identical to SEQ ID NO: 188

SEQ ID NO: 190 - protein, 201 aa, Neisseria meningitidis
MTIYFKNGFYDDTLGSIPEGAVAVRAEEYAALLAGQAQGGQIAADSDGRPVLTPPRPSEYHEWDGKKWEIGEAAAAARFAEQKTATAFRLAAKADELKNSLLAGYPQVEIDSFYRQEKEALARQADNNAPTPMLAQIAAARGVELDVLIEKVVEKSARLAVAAGAIIGKRQQLEDKLNTIETAPGLDALEKEIEEWTLNIG

SEQ ID NO: 191 - protein, 188 aa, Neisseria meningitidis
NGFYDDTLGSIPEGAVAVRAEEYAALLAGQAQGGQIAADSDGRPVLTPPRPSDYHEWDGKKWKISKAAAAARFAEQKTATAFRLAEKADELKNSLLAGYPQVEIDSFYRQEKEALARQADNNAPTPMLAQIAAARGVELDVLIEKVVEKSARLAVAAGAIIGKRQQLEDKLNAIETAPGLDALEKEIE

SEQ ID NO: 192 - protein, 201 aa, Neisseria meningitidis
MTIYFKNGFYDDTLGSIPEGAVAVRAEEYAALLAGQAQGGQIAADSDGRPVLTPPRPSDYHEWDGKKWKIGKAAAAARFAEQKTATAFRLAEKADELKNSLLAGYPQVEIDSFYRQEKEALARQADNNAPTPMLAQIAAARGVELDVLIEKVVEKSARLAVAAGAIIGKRQQLEDKLNAIETAPGLDALEKEIEEWTLNIG

SEQ ID NO: 193 - protein, 201 aa, Neisseria meningitidis
MTIYFKNGFYDDTLGGIPEGAVAVRAEEYAALLAGQAQGGQIAADSDGRPVLTPPRPSDYHEWDGKKWKISKAAAAARFAKQKTALAFRLAEKADELKNSLLAGYPQVEIDSFYRQEKEALARQADNNAPTPMLAQIAAARGVELDVLIEKVIEKSARLAVAAGAIIGKRQQLEDKLNTIETAPGLDALEKEIEEWTLNIG

SEQ ID NO: 194 - protein, 191 aa, Neisseria meningitidis
ISKTGFYDDTLGSIPEGAVAVRAEEYAALLAGQTQGGQIAADSDGRPVLTPPRPSEYHEWDGKKWEIGEAAAAARFAEQKTATAFRLAAKADELKNSLLAGYPQVEIDSFYRQEKEALARQADNNAPTPMLAQIAAARGVELDVLIEKVVEKSARLAVAAGAIIGKRQQLEDKLNAIETAPGLDALEKEIE

SEQ ID NO: 195 - protein, 197 aa, Neisseria meningitidis
IYFKNGFYDDTLGSIPEGAVAVRAEEYAALLAGQTQGGQIAADSDGRPVLTPPRPSEYHEWDGKKWEIGEAAAAARFAEQKTATAFRLAAKADELKNSLLAGYPQVEIDSFYRQEKEALARQADNNAPTPMLAQIAAARGVELDVLIEKVVEKSARLAVAAGAIIGKPAAARRQIEHHRNPRPGLDALEKEIEEWTA

SEQ ID NO: 196 - protein, 187 aa, Neisseria meningitidis
MKKIIIAALAAAAVGTASAATYKVDEYHANARFAIDHFNTSTNVGGFYGLTGSVEFDQAKRDGKIDITIPVANLQSGSQHFTDHLKSADIFDAAQYPDIRFVSTKFNFNGKKLVSVDGNLTMHGKTAPVKLKAEKFNCYQSPMEKTEVCGGDFSTTIDRTKWGVDYLVNVGMTKSVRIDIQIEAAKQ

SEQ ID NO: 197 - protein, 187 aa, Neisseria meningitidis
MKKIIFAALAAAAVGTASAATYKVDEYHANARFAIDHFNTSTNVGGFYGLTGSVEFDQAKRDGKIDITIPVANLQSGSQHFTDHLKSADIFDAAQYPDIRFVSTKFNFNGKKLVSVDGNLTMHGKTAPVKLKAEKFNCYQSPMEKTEVCGGDFSTTIDRTKWGVDYLVNVGMTKSVRIDIQIEAAKQ

SEQ ID NO: 198 - protein, 187 aa, Neisseria meningitidis
MKKIIFAALAAAAVGTASAATYKVDEYHANARFAIDHFNTSTNVGGFYGLTGSVEFDQAKRDGKIDITIPVANLQSGSQHFTDHLKSADIFDAAQYPDIRFVSTKFNFNGKKLVSVDGNLTMHGKTAPVKLKAEKFNCYQSPMAKTEVCGGDFSTTIDRTKWGVDYLVNVGMTKSVRIDIQIEAAKQ

SEQ ID NO: 199 - protein, 187 aa, Neisseria meningitidis; identical to SEQ ID NO: 198

SEQ ID NO: 200 - protein, 187 aa, Neisseria meningitidis; identical to SEQ ID NO: 198

SEQ ID NO: 201 - protein, 187 aa, Neisseria meningitidis
MKKIIFAALEAAAVGTASAATYKVDEYHANARFAIDHFNTSTNVGGFYGLTGSVEFDQAKRDGKIDITIPVANLQSGSQHFTDHLKSADIFDAAQYPDIRFVSTKFNFNGKKLVSVDGNLTMHGKTAPVKLKAEKFNCYQSPMAKTEVCGGDFSTTIDRTKWGVDYLVNVGMTKSVRIDIQIEAAKQ

SEQ ID NO: 202 - protein, 187 aa, Neisseria meningitidis
MKKIIFAALAAAAISTASAATYKVDEYHANARFAIDHFNTSTNVGGFYGLTGSVEFDQAKRDGKIDITIPIANLQSGSQHFTDHLKSADIFDAAQYPDIRFVSTKFNFNGKKLVSVDGNLTMHGKTAPVKLKAEKFNCYQSPMEKTEVCGGDFSTTIDRTKWGMDYLVNVGMTKSVRIDIQIEAAKQ

SEQ ID NO: 203 - protein, 187 aa, Neisseria meningitidis
MKKIIIAALAAAAIGTASAATYKVDEYHANARFSIDHFNTSTNVGGFYGLTGSVEFDQAKRDGKIDITIPVANLQSGSQHFTDHLKSADIFDAAQYPDIRFVSTKFNFNGKKLVSVDGNLTMHGKTAPVKLKAEKFNCYQSPMLKTEVCGGDFSTTIDRTKWGMDYLVNVGMTKSVRIDIQIEAAKQ

SEQ ID NO: 204 - protein, 17 aa, Neisseria meningitidis
MNKIYRIIWNSALNAWV

SEQ ID NO: 205 - protein, 16 aa, Neisseria meningitidis
VSELTRNHTKRASATV

SEQ ID NO: 206 - protein, 8 aa, Neisseria meningitidis
TAVLATLL

SEQ ID NO: 207 - protein, 12 aa, Neisseria meningitidis
TLKAGDNLKIKQ

SEQ ID NO: 208 - protein, 15 aa, Neisseria meningitidis
FTYSLKKDLTDLTSV

SEQ ID NO: 209 - protein, 10 aa, Neisseria meningitidis
TEKLSFGANG

SEQ ID NO: 210 - protein, 23 aa, Neisseria meningitidis
KVNITSDTKGLNFAKETAGTNGD

SEQ ID NO: 211 - protein, 15 aa, Neisseria meningitidis
TVHLNGIGSTLTDTL

SEQ ID NO: 212 - protein, 19 aa, Neisseria meningitidis
  MISC_FEATURE (5)..(5): Xaa=Val or Ile
RAASXKDVLNAGWNIKGVK

SEQ ID NO: 213 - protein, 56 aa, Neisseria meningitidis
NVDFVRTYDTVEFLSADTKTTTVNVESKDNGKKTEVKIGAKTSVIKEKDGKLVTGK

SEQ ID NO: 214 - protein, 53 aa, Neisseria meningitidis
KGENGSSTDEGEGLVTAKEVIDAVNKAGWRMKTTTANGQTGQADKFETVTSGT

SEQ ID NO: 215 - protein, 16 aa, Neisseria meningitidis
GTTATVSKDDQGNITV

SEQ ID NO: 216 - protein, 72 aa, Neisseria meningitidis
YDVNVGDALNVNQLQNSGWNLDSKAVAGSSGKVISGNVSPSKGKMDETVNINAGNNIEITRNGKNIDIATSM

SEQ ID NO: 217 - protein, 20 aa, Neisseria meningitidis
PQFSSVSLGAGADAPTLSVD

SEQ ID NO: 218 - protein, 116 aa, Neisseria meningitidis
NKPVRITNVAPGVKEGDVTNVAQLKGVAQNLNNRIDNVDGNARAGIAQAIATAGLVQAYLPGKSMMAIGGGTYRGEAGYAIGYSSISDGGNWIIKGTASGNSRGHFGASASVGYQW

SEQ ID NO: 219 - protein, 40 aa, Neisseria meningitidis
MKTFFKTLSAAALALILAACGGQKDSAPAASASAAADNGA

SEQ ID NO: 220 - protein, 19 aa, Neisseria meningitidis
KKEIVFGTTVGDFGDMVKE

SEQ ID NO: 221 - protein, 223 aa, Neisseria meningitidis
ELEKKGYTVKLVEFTDYVRPNLALAEGELDINVFQHKPYLDDFKKEHNLDITEVFQVPTAPLGLYPGKLKSLEEVKDGSTVSAPNDPSNFARVLVMLDELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKSPAAWNEGAAK

SEQ ID NO: 222 - protein, 12 aa, Neisseria meningitidis
MFKRSVIAMACI

SEQ ID NO: 223 - protein, 20 aa, Neisseria meningitidis
ALSACGGGGGGSPDVKSADT

SEQ ID NO: 224 - protein, 8 aa, Neisseria meningitidis
SKPAAPVV

SEQ ID NO: 225 - protein, 7 aa, Neisseria meningitidis
QDMAAVS

SEQ ID NO: 226 - protein, 12 aa, Neisseria meningitidis
ENTGNGGAATTD

SEQ ID NO: 227 - protein, 13 aa, Neisseria meningitidis
DGPSQNITLTHCK

SEQ ID NO: 228 - protein, 58 aa, Neisseria meningitidis
RRSARSRRSLPAEMPLIPVNQADTLIVDGEAVSLTGHSGNIFAPEGNYRYLTYGAEKL

SEQ ID NO: 229 - protein, 25 aa, Neisseria meningitidis
VQGEPAKGEMLAGTAVYNGEVLHFH

SEQ ID NO: 230 - protein, 27 aa, Neisseria meningitidis
GRFAAKVDFGSKSVDGIIDSGDDLHMG

SEQ ID NO: 231 - protein, 62 aa, Neisseria meningitidis
  MISC_FEATURE (27)..(27): Xaa = Arg or Lys
QKFKAAIDGNGFKGTWTENGGGDVSGXFYGPAGEEVAGKYSYRPTDAEKGGFGVFAGKKDRD

SEQ ID NO: 232 - protein, 8 aa, Neisseria meningitidis
MEFFIILL

SEQ ID NO: 233 - protein, 130 aa, Neisseria meningitidis
AVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVV

SEQ ID NO: 234 - protein, 176 aa, Neisseria meningitidis
ALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEANRQIAAALQTQSGADAVNLKIAGQYVTAFKNLAKEDNTRIKPAKVAEIGNPNFRRHEKFSPEAKTAK

SEQ ID NO: 235 - protein, 10 aa, Neisseria meningitidis
MKKYLFRAAL

SEQ ID NO: 236 - protein, 185 aa, Neisseria meningitidis
  MISC_FEATURE (44)..(44): Xaa = Gly or Ala
GIAAAILAACQSKSIQTFPQPDTSVINGPDRPVGIPDPAGTTVXGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDN

SEQ ID NO: 237 - protein, 9 aa, Neisseria meningitidis
GGTHTADLS

SEQ ID NO: 238 - protein, 104 aa, Neisseria meningitidis
  MISC_FEATURE (85)..(85): Xaa = Arg or Lys
FPITARTTAIKGRFEGSRFLPYHTRNQINGGALDGKAPILGYAEDPVELFFMHIQGSGRLKTPSGKYIRIGYADKNEHPYVSIGXYMADKGYLKLGQTSMQGIK

SEQ ID NO: 239 - protein, 25 aa, Neisseria meningitidis
YMRQNPQRLAEVLGQNPSYIFFREL

SEQ ID NO: 240 - protein, 100 aa, Neisseria meningitidis
NDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 241 - protein, 63 aa, Neisseria meningitidis
RKISLILSILAVCLPMHAHASDLANDSFIRQVLDRQHFEPDGKYHLFGSRGELAERSGHIGLG

SEQ ID NO: 242 - protein, 125 aa, Neisseria meningitidis
IQSHQLGNLMIQQAAIKGNIGYIVRFSDHGHEVHSPFDNHASHSDSDEAGSPVDGFSLYRIHWDGYEHHPADGYDGPQGGGYPAPKGARDIYSYDIKGVAQNIRLNLTDNRSTGQRLADRFHNAG

SEQ ID NO: 243 - protein, 119 aa, Neisseria meningitidis
MLTQGVGDGFKRATRYSPELDRSGNAAEAFNGTADIVKNIIGAAGEIVGAGDAVQGISEGSNIAVMHGLGLLSTENKMARINDLADMAQLKDYAAAAIRDWAVQNPNAAQGIEAVSNIF

SEQ ID NO: 244 - protein, 41 aa, Neisseria meningitidis
  MISC_FEATURE (23)..(23): Xaa = Val or Ile
IPIKGIGAVRGKYGLGGITAHPXKRSQMGEIALPKGKSAVS

SEQ ID NO: 245 - protein, 73 aa, Neisseria meningitidis
NFADAAYAKYPSPYHSRNIRSNLEQRYGKENITSSTVPPSNGKNVKLANKRHPKTKVPFDGKGFPNFEKDVKY

SEQ ID NO: 246 - protein, 13 aa, Neisseria meningitidis
IYFKNGFYDDTLG

SEQ ID NO: 247 - protein, 52 aa, Neisseria meningitidis
IPEGAVAVRAEEYAALLAGQAQGGQIAADSDGRPVLTPPRPSSYHEWDGKKW

SEQ ID NO: 248 - protein, 19 aa, Neisseria meningitidis
AAAAARFAEQKTATAFRLA

SEQ ID NO: 249 - protein, 86 aa, Neisseria meningitidis
  MISC_FEATURE (61)..(61): Xaa = Ile or Val
KADELKNSLLAGYPQVEIDSFYRQEKEALARQADNNAPTPMLAQIAAARGVELDVLIEKVXEKSARLAVAAGAIIGKRQQLEDKLN

SEQ ID NO: 250 - protein, 18 aa, Neisseria meningitidis
IETAPGLDALEKEIEEWT

SEQ ID NO: 251 - protein, 143 aa, Neisseria meningitidis
  MISC_FEATURE (71)..(71): Xaa = Ile or Val
MKKIIFAALAAAAVGTASAATYKVDEYHANARFAIDHFNTSTNVGGFYGLTGSVEFDQAKRDGKIDITIPXANLQSGSQHFTDHLKSADIFDAAQYPDIRFVSTKFNFNGKKLVSVDGNLTMHGKTAPVKLKAEKFNCYQSPM

SEQ ID NO: 252 - protein, 127 aa, Neisseria meningitidis
  MISC_FEATURE (52)..(52): Xaa = Ile or Val
ATYKVDEYHANARFAIDHFNTSTNVGGFYGLTGSVEFDQAKRDGKIDITIPXANLQSGSQHFTDHLKSADIFDAAQYPDIRFVSTKFNFNGKKLVSVDGNLTMHGKTAPVKLKAEKFNCYQSPMAND

SEQ ID NO: 253 - protein, 43 aa, Neisseria meningitidis
  MISC_FEATURE (20)...(20): Xaa = Met or Val
KTEVCGGDFSTTIDRTKWGXDYLVNVGMTKSVRIDIQIEAAKQ

SEQ ID NO: 254 - protein, 6 aa, Neisseria meningitidis
QNDMPQ

SEQ ID NO: 255 - protein, 5 aa, Neisseria meningitidis
KSEFE

SEQ ID NO: 256 - protein, 6 aa, Neisseria meningitidis
GGSYAL

The invention claimed is:

1. An isolated protein fragment comprising the amino acid sequence of NKPVILITNVAPGVKEGDVTNVAQLKGV-AQNLNNRIDNVDGNARAGIAQAIATAGLVQAYLPG-KSMMAIGGGTYRGEAGYAIGYSSISDGGNWIIKGTA-SGNSRGHFGASASVGYQW (SEQ ID NO:218), provided that said protein fragment is not full length *N. meningitidis* serogroup B ORF40.

2. The isolated protein fragment of claim 1 consisting of the amino acid sequence of SEQ ID NO:218.

* * * * *

UNITED STATES PATENT AND TRADEMARK OFFICE
CERTIFICATE OF CORRECTION

| | | |
|---|---|---|
| PATENT NO. | : 7,368,261 B1 | Page 1 of 1 |
| APPLICATION NO. | : 09/980602 | |
| DATED | : May 6, 2008 | |
| INVENTOR(S) | : Rino Rappuoli | |

It is certified that error appears in the above-identified patent and that said Letters Patent is hereby corrected as shown below:

In the Claims:

At Column 49, Line 3, Claim 1, delete
"NKPVILITNVAPGVKEGDVTNVAQLKGVAQNLNNRIDNVDGN ARAGIAQAIATAGLVQAYLPGKSMMAIGGGTYRGEAGYAIGYSSISDGG NWIIKGTASGNSRGHFGASASVGYQW" and replace with
--NKPVRITNVAPGVKEGDVTNVAQLKGVAQNLNNRIDNVDGNARAGIAQAIATAGLVQAY LPGKSMMAIGGGTYRGEAGYAIGYSSISDGGNWIIKGTASGNSRGHFGASASVGYQW--

Signed and Sealed this
First Day of February, 2011

David J. Kappos
*Director of the United States Patent and Trademark Office*